United States Patent
Wee

(10) Patent No.: US 11,453,879 B2
(45) Date of Patent: Sep. 27, 2022

(54) METHOD FOR SCREENING SPLICING VARIANTS OR EVENTS

(71) Applicant: Agency for Science, Technology and Research, Singapore (SG)

(72) Inventor: Keng Boon Wee, Singapore (SG)

(73) Assignee: Agency for Science, Technology and Research, Singapore (SG)

(*) Notice: Subject to any disclaimer, the term of this patent is extended or adjusted under 35 U.S.C. 154(b) by 297 days.

(21) Appl. No.: 16/638,100

(22) PCT Filed: Aug. 13, 2018

(86) PCT No.: PCT/SG2018/050408
§ 371 (c)(1),
(2) Date: Feb. 10, 2020

(87) PCT Pub. No.: WO2019/032054
PCT Pub. Date: Feb. 14, 2019

(65) Prior Publication Data
US 2020/0392488 A1 Dec. 17, 2020

(30) Foreign Application Priority Data
Aug. 11, 2017 (SG) .......................... 10201706585X

(51) Int. Cl.
*C12N 15/11* (2006.01)
(52) U.S. Cl.
CPC ........ *C12N 15/111* (2013.01); *C12N 2310/11* (2013.01); *C12N 2310/315* (2013.01); *C12N 2310/321* (2013.01); *C12N 2310/33* (2013.01)

(58) Field of Classification Search
None
See application file for complete search history.

(56) References Cited

U.S. PATENT DOCUMENTS 5,149,797 A 9/1992 Agrawal et al.

FOREIGN PATENT DOCUMENTS

| WO | WO 2002/024906 A1 | 3/2002 |
| WO | WO 2007/135105 A1 | 11/2007 |
| WO | WO 2011/078797 A2 | 6/2011 |

OTHER PUBLICATIONS

Aartsma-Rus et al. Am. J. Hum. Genet. 2004, vol. 74, pp. 83-92.*
Aartsma-Rus et al., Functional analysis of 114 exon-internal AONs for targeted DMD exon skipping: indication for steric hindrance of SR protein binding sites. Oligonucleotides. Dec. 2005;15(4):284-97. doi: 10.1089/oli.2005.15.284. PMID: 16396622.
Agrawal et al., Site-specific excision from RNA by RNase H and mixed-phosphate-backbone oligodeoxynucleotides. Proc Natl Acad Sci U S A. Feb. 1990;87(4): 1401-5. doi: 10.1073/pnas.87.4.1401. PMID: 2154746; PMCID: PMC53483.
Baker et al., Effects of oligo sequence and chemistry on the efficiency of oligodeoxyribonucleotide-mediated mRNA cleavage. Nucleic Acids Res. Jun. 25, 1990;18(12):3537-43. doi: 10.1093/nar/18.12.3537. PMID: 2362806; PMCID: PMC331008.
Furdon et al., RNase H cleavage of RNA hybridized to oligonucleotides containing methylphosphonate, phosphorothioate and phosphodiester bonds. Nucleic Acids Res. Nov. 25, 1989;17(22):9193-204. doi: 10.1093/nar/17.22.9193. PMID: 2555787; PMCID: PMC335124.
Jirka et al., Evaluation of 2'-Deoxy-2'-fluoro Antisense Oligonucleotides for Exon Skipping in Duchenne Muscular Dystrophy. Mol Ther Nucleic Acids. Dec. 1, 2015;4(12):e265. doi: 10.1038/mtna.2015.39. PMID: 26623937; PMCID: PMC5014533.
Miskew et al., Multi-exon Skipping Using Cocktail Antisense Oligonucleotides in the Canine X-linked Muscular Dystrophy. J Vis Exp. May 24, 2016;(111):53776. doi: 10.3791/53776. PMID: 27285612; PMCID: PMC4927712.
Porensky et al., Antisense oligonucleotides for the treatment of spinal muscular atrophy. Hum Gene Ther. May 2013;24(5):489-98. doi: 10.1089/hum.2012.225. PMID: 23544870; PMCID: PMC3655628.
Pramono et al., A prospective study in the rational design of efficient antisense oligonucleotides for exon skipping in the DMD gene. Hum Gene Ther. Jul. 2012;23(7):781-90. doi: 10.1089/hum.2011.205. Epub Jul. 13, 2012. PMID: 22486275; PMCID: PMC3404420.
Sproat et al., Highly efficient chemical synthesis of 2'-O-methyloligoribonucleotides and tetrabiotinylated derivatives; novel probes that are resistant to degradation by RNA or DNA specific nucleases. Nucleic Acids Res. May 11, 1989;17(9):3373-86. doi: 10.1093/nar/17.9.3373. PMID: 2726482; PMCID: PMC317781.
Walder et al., Role of RNase H in hybrid-arrested translation by antisense oligonucleotides. Proc Natl Acad Sci U S A. Jul. 1988;85(14):5011-5. doi: 10.1073/pnas.85.14.5011. PMID: 2839827; PMCID: PMC281677.

(Continued)

*Primary Examiner* — Tracy Vivlemore
(74) *Attorney, Agent, or Firm* — Wolf, Greenfield & Sacks, P.C.

(57) ABSTRACT

The present invention relates to a high-throughput method of screening splicing variants of target genes as drug targets or for characterisation of their biological functions. The disclosure provides a method for the screening of splicing variants, comprising: (a) providing a first antisense oligonucleotide capable of inducing a first splice event on the target gene to express a first splicing variant, and a second antisense oligonucleotide capable of inducing a second splice event on the target gene to express a second splicing variant; (b) hybridising the first and second antisense oligonucleotides to a pre-mRNA of the target gene; and (c) characterising the effect of the splice event. In one embodiment, the first antisense oligonucleotide switches the splice event that expresses the second splicing variant towards one that expresses the first splicing variant, while the second antisense oligonucleotide switches the splice event that expresses the first splicing variant towards one that expresses the second splicing variant.

Figure 1A:
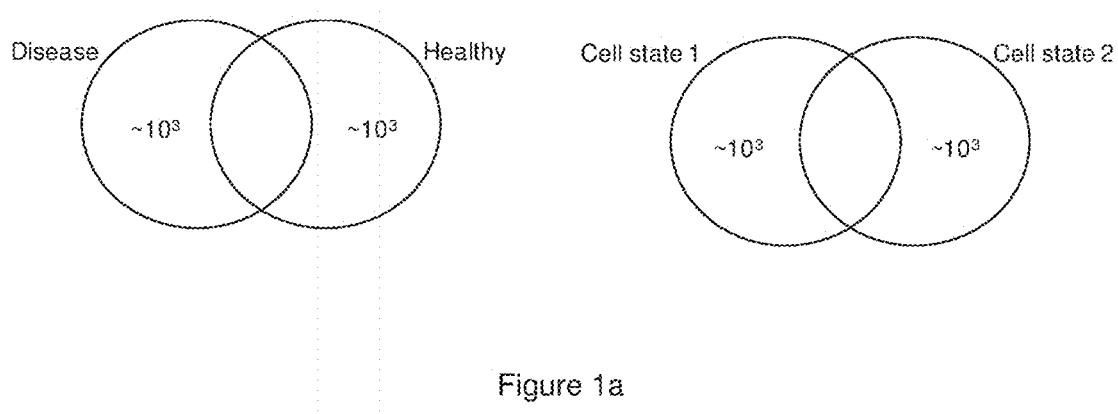

14 Claims, 14 Drawing Sheets
Specification includes a Sequence Listing.

(56) References Cited

OTHER PUBLICATIONS

Wee et al., Dynamics of co-transcriptional pre-mRNA folding influences the induction of dystrophin exon skipping by antisense oligonucleotides. PLoS One. Mar. 26, 2008;3(3):e1844. doi: 10.1371/journal.pone.0001844. PMID: 18365002; PMCID: PMC2267000.

* cited by examiner

Types of screens (1) Drug target discovery (2) Enhancer drug target discovery

Types of screens

(3) Synthetic lethality

Non-transformed cells

Cancer cells

(4) Functional studies

Cell state 1

Cell state 2

METHOD FOR SCREENING SPLICING VARIANTS OR EVENTS

RELATED APPLICATIONS

This application is a national stage filing under 35 U.S.C. § 371 of international application number PCT/SG2018/050408, filed Aug. 13, 2018, which claims the benefit of Singaporean application number 10201706585X, filed Aug. 11, 2017, each of which is herein incorporated by reference in its entirety.

REFERENCE TO A SEQUENCE LISTING SUBMITTED AS A TEXT FILE VIA EFS-WEB

This application contains a Sequence Listing which has been submitted in ASCII format via EFS-Web and is hereby incorporated by reference in its entirety. Said ASCII copy, created on May 2, 2022, is named 5150770136US00-SEQ-JDH and is 745,257 bytes in size.

The present invention relates to a method of screening splicing variants or events of at least one target gene. In particular, the method relates to the high-throughput screen of splicing variants or isoforms of target genes as drug targets or for characterisation of their biological functions in a transcriptome-wide scale. In various embodiments, the method employs the use of splice-switching steric hindrance antisense oligonucleotides to screen and identify isoforms that arise from alternative or aberrant splicing as drug targets. The present method uses such splice-switching steric hindrance antisense oligonucleotides to characterise the biological function of isoforms that arise from alternative or aberrant splicing.

The reducing cost of next-generation sequencing (NGS) has rapidly uncovered differential alternative splicing (AS) and circular splicing (CS) events at the transcriptome-wide scale that numbers in hundreds to thousands of isoform variants and splice events between a particular tumor (for instance) and its corresponding normal cells (see FIG. 1a). In the former, proteins translated by cancer-associated isoforms have opposing biological functions as proteins translated from isoforms expressed in its normal counterparts. For instance, the short-form IG20/MADD protein translated from the isoform expressed in cancer cells, which lacks exon 16, inhibits cell death, whereas its long-form isoform, which retains exon 16, expressed in normal cells translates a protein that promotes cell death. In another example, the long isoform of BIN1 with exon 12A inclusion is expressed in melanoma whereas the short isoform (without exon 12A) is expressed in melanocyte (see FIG. 2 for some examples). For the latter, differential expressions of circRNAs have been observed between healthy and diseased cells and between cells at various physiological states. Importantly, the expression of specific circRNAs, or the lack of, is correlated with diseases including atherosclerosis, cancers and in Parkinson's disease.

Although studies have shown that alternative splicing plays a major role in generating protein diversity and that its de-regulation is implicated in human diseases, standard analyses may not allow for a full interrogation of how alternative and aberrant splicing modulates gene function. A huge challenge in the post-genomic era is the lack of validated platform technologies for high-throughput functional genomics studies that can keep up with the enormous data generation. In this context, platform technologies for the functional study of each of the thousands of alternatively spliced isoforms, splice events and/or circularly spliced circRNAs to identify those that are disease drivers for therapeutic targeting are highly desired.

The listing or discussion of an apparently prior-published document in this specification should not necessarily be taken as an acknowledgement that the document is part of the state of the art or is common general knowledge.

Any document referred to herein is hereby incorporated by reference in its entirety.

In an aspect of the present invention, there is provided a method for the screening of splicing variants or events of a target gene, the method comprises: (a) providing a first antisense oligonucleotide capable of inducing a first splice event on the target gene to express a first splicing variant, and a second antisense oligonucleotide capable of inducing a second splice event on the target gene to express a second splicing variant; (b) hybridising the first and second antisense oligonucleotides to a pre-mRNA of the target gene; and (c) characterising the effect of the splice event.

In particular, the method of the present invention comprises identifying differential expressions of an isoform between groups of cells or identifying expression of an isoform that are similarly expressed in groups of cells. Differential expressions may include between cells before and after treatment with drugs and/or biological reagents or procedures or disease-free and disease-manifesting cells or cells before and after undergoing biological processes (such as development or differentiation).

In various embodiments, the present invention presents a 1-way splice-switching screening method where a single AON induces or causes a splice event from taking place and which said method includes the step of characterising that event by looking into the phenotype of the cells which expresses that isoform and determining what effect that splice event has on the cell, i.e. how and what state the splice event changes the phenotype of the cell. For example, the AON may cause a splice event that results in the expression of an isoform of the target gene which causes an otherwise healthy cell to be diseased or unhealthy. In other embodiments, that will be described in detail below, a 2-way splice-switching screen is disclosed where AONs of the present invention are used to characterise splice events switch expression of the two isoform back and forth.

By "splicing variants", it is meant to include any protein isoforms that originate from a single target gene or gene family. These protein isoforms may be formed or produced from any such "splicing event" or mechanisms such as alternative splicings, or other post-transcriptional modifications. The term also includes any multiple protein isoforms that can differ in both structure and composition. Through such splicing events, the cellular machinery has the ability to select different protein-coding segments (exons) of a gene, or even different parts of exons from RNA to form different mRNA sequences. Splicing of pre-mRNA is required for the proper expression of the vast majority of protein-coding genes, and thus, targeting the process offers a means to manipulate protein production from a gene. In this document, the terms "splicing variants" and "isoforms" may be used interchangeably. This document describes a full list of possible splicing events below.

The splicing process is actually a series of reactions, mediated by splicing factors, which is carried out on nascent RNA after transcription but before translation. Thus, a "pre-mRNA" is an RNA which contains both exons and intron(s), and an "mRNA" is an RNA (mature mRNA) in which the intron(s) have been removed and the exons joined together sequentially so that the protein may be translated therefrom by the ribosomes.

A splicing variant or alternative splicing variant of the target gene, which arise from one of more simultaneous splicing events, includes known and annotated transcripts and novel and/or un-annotated transcripts.

By "oligonucleotide", it is meant to refer to any polynucleotide. A "polynucleotide" is an oligomer comprised of nucleotides. A polynucleotide may be comprised of DNA, RNA modified forms thereof, or a combination thereof. The term "nucleotide" or its plural as used herein is interchangeable with modified forms as discussed herein and otherwise known in the art. In certain instances, the art uses the term "nucleobase" which embraces naturally occurring nucleotides as well as modifications of nucleotides that can be polymerized. Thus, nucleotide or nucleobase means the naturally occurring nucleobases adenine (A), guanine (G), cytosine (C), thymine (T) and uracil (U) as well as non-naturally occurring nucleobases such as xanthine, diaminopurine, 8-oxo-N6-methyladenine, 7-deazaxanthine, 7-deazaguanine, N4,N4-ethanocytosin, N',N'-ethano-2,6-diaminopurine, 5-methylcytosine (mC), 5-(C[3]-C6)-alkynyl-cytosine, 5-fluorouracil, 5-bromouracil, pseudoisocytosine, 2-hydroxy-5-methyl-4-tr-iazolopyridin, isocytosine, isoguanine, inosine and the "non-naturally occurring" nucleobases described in Benner et ah, U.S. Pat. No. 5,432,272 and Susan M. Freier and Karl-Heinz Altmann, 1997, Nucleic Acids Research, vol. 25: pp 4429-4443. The term "nucleobase" also includes not only the known purine and pyrimidine heterocycles, but also heterocyclic analogues and tautomers thereof. Further naturally and non-naturally occurring nucleobases include those disclosed in U.S. Pat. No. 3,687,808 (Merigan, et ah), in Chapter 15 by Sanghvi, in Antisense Research and Application, Ed. S. T. Crooke and B. Lebleu, CRC Press, 1993, in Englisch et ah, 1991, Angewandte Chemie, International Edition, 30: 613-722 (see especially pages 622 and 623, and in the Concise Encyclopedia of Polymer Science and Engineering, J. I. Kroschwitz Ed., John Wiley & Sons, 1990, pages 858-859, Cook, Anti-Cancer Drug Design 1991, 6, 585-607, each of which is hereby incorporated by reference in its entirety). In various aspects, polynucleotides also include one or more "nucleosidic bases" or "base units" which include compounds such as heterocyclic compounds that can serve like nucleobases, including certain "universal bases" that are not nucleosidic bases in the most classical sense but serve as nucleosidic bases. Universal bases include 3-nitropyrrole, optionally substituted indoles {e.g., 5-nitroindole), and optionally substituted hypoxanthine. Other desirable universal bases include pyrrole, and diazole or triazole derivatives, including those universal bases known in the art.

Polynucleotides may also include modified nucleobases. A "modified base" is understood in the art to be one that can pair with a natural base {e.g., adenine, guanine, cytosine, uracil, and/or thymine) and/or can pair with a non-naturally occurring base. Exemplary modified bases are described in EP 1 072 679 and WO 97/12896, the disclosures of which are incorporated herein by reference. Modified nucleobases include, without limitation, 5-methylcytosine (5-me-C), 5-hydroxymethyl cytosine, xanthine, hypoxanthine, 2-aminoadenine, 2-O-methyl, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine. Further modified bases include tricyclic pyrimidines such as phenoxazine cytidine (IH-pyrimido[5,4-b] [I,4]benzoxazin-2(3H)-one), phenothiazine cytidine (IH-pyrimido[5,4-b] [I,4]benzothiazin-2(3H)-one), G-clamps such as a substituted phenoxazine cytidine (e.g. 9-(2-aminoethoxy)-H-pyrimido[5,4-b] [I,4]benzox-azin-2(3H)-one), carbazole cytidine (2H-pyrimido[4,5-b]indol-2-one), pyridoindole cytidine (H-pyrido[3',2':4,5]pyrrolo[2,3-d]pyrimidin-2-one). Modified bases may also include those in which the purine or pyrimidine base is replaced with other heterocycles, for example 7-deaza-adenine, 7-deazaguanosine, 2-aminopyridine and 2-pyridone. Additional nucleobases include those disclosed in U.S. Pat. No. 3,687,808, those disclosed in The Concise Encyclopedia Of Polymer Science And Engineering, pages 858-859, Kroschwitz, J. I., ed. John Wiley & Sons, 1990, those disclosed by Englisch et ah, 1991, Angewandte Chemie, International Edition, 30: 613, and those disclosed by Sanghvi, Y. S., Chapter 15, Antisense Research and Applications, pages 289-302, Crooke, S. T. and Lebleu, B., ed., CRC Press, 1993. Certain of these bases are useful for increasing the binding affinity of the polynucleotide and include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2.deg. C. and are, in certain aspects, combined with 2'-O-methoxyethyl sugar modifications. See, U. S. Pat. Nos. 3,687,808, 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,645,985; 5,830,653; 5,763,588; 6,005,096; 5,750,692 and 5,681,941, the disclosures of which are incorporated herein by reference.

By "antisense oligonucleotide", it is meant to include any short nucleic acid sequence short, synthetic, antisense, modified nucleic acids that hybridises or base-pairs with a pre-mRNA in a sequence-specific manner via Watson-Crick base pairing and can disrupt the normal splicing repertoire of the transcript by blocking the RNARNA base-pairing or protein-RNA binding interactions that occur between components of the splicing machinery and the pre-mRNA. The nucleic acid is termed an "antisense oligonucleotide" (AON) because its base sequence is complementary to the target gene's messenger RNA (mRNA), which is called the "sense" sequence. Formation of the AON-mRNA heteroduplex either triggers RNase H activity, leading to mRNA degradation, induces translational arrest by steric hindrance of ribosomal activity, interferes with mRNA maturation by inhibiting splicing or destabilizes pre-mRNA in the nucleus, resulting in downregulation of target protein expression. The AON is not only a useful experimental tool in protein target identification and validation, but also a highly selective therapeutic strategy for diseases with dysregulated protein expression.

Those of skill in the art can readily design antisense polynucleotides according to the present disclosure. For example, general teachings in the art include, but are not limited to, Wee et al, PLoS One. 3: e1844 (2008), Pramono et al, Human Gene Ther. 23: 781-790 (2012), Aartsma-Rus et al, Methods Mol Biol. 867: 117-29 (2012); Aartsma-Rus et al, Methods Mol Biol. 867: 97-116 (2012); van Roon-Mom et al., Methods Mol Biol. 867: 79-96 (2012), each of which is incorporated herein by reference. General guidelines also include attempting to avoid 3 consecutive G or C nucleotides, choosing lengths and sequences that favour self structure (hairpinning will be avoided), and avoiding those sequences likely to form primer dimers. In some embodiments, an antisense polynucleotide of the disclosure is one that is designed to specifically hybridize to an exon or an intron or an intron-exon boundary, such that the antisense polynucleotide specifically hybridises to a sequence that is completely within an exon of a nucleic acid, or about one nucleotide of the antisense polynucleotide spans said intron-exon boundary when the antisense polynucleotide is specifically hybridised to the nucleic acid. In some embodiments wherein the antisense polynucleotide specifically hybridizes to a sequence that is completely within an exon, it is contemplated that a terminus of the antisense polynucleotide is about 1, 2, 3, 4, 5, 6, 7, 8, 9, 10 or more nucleotides from a terminus of the exon.

In other embodiments, an antisense polynucleotide of the disclosure is one that is designed to specifically hybridize to an intron-exon boundary of a target nucleic acid, such that about 2, 3, 4, 5, 6, 7, 8, 9, 10 or more nucleotides of the antisense polynucleotide span said intron-exon boundary. It is understood that a nucleotide can "span the intron-exon boundary" on either the exon side or intron side. Thus, an antisense polynucleotide that specifically and predominantly hybridises to intronic sequence and only hybridizes to one nucleotide of an adjoining exon would "span the intron-exon boundary" by one nucleotide. Similarly, an antisense polynucleotide that specifically hybridizes to exonic sequence and only hybridises to one nucleotide of an adjoining intron would "span the intron-exon boundary" by one nucleotide. In any of the aforementioned embodiments, the antisense polynucleotide is at least about 10 nucleotides and up to about 15, 20, 25, 30, 35, 40, 45, 50 or more nucleotides in length.

In various embodiments, the antisense oligonucleotide may comprise a modified polynucleotide backbone. The modified polynucleotide backbone may comprise a modified moiety substituted for the sugar of at least one of the polynucleotides.

Modified polynucleotides are contemplated for use wherein both one or more sugar and/or one or more internucleotide linkage of the nucleotide units in the polynucleotide is replaced with "non-naturally occurring" sugars (i.e., sugars other than ribose or deoxyribose) or internucleotide linkages, respectively. In one aspect, this embodiment contemplates a peptide nucleic acid (PNA). In PNA compounds, the sugar-backbone of a polynucleotide is replaced with an amide-containing (e.g., peptide bonds between N-(2-aminoethyl)-glycine units) backbone. See, for example U.S. Pat. Nos. 5,539,082; 5,714,331; and 5,719,262, and Nielsen et ah, Science, 1991, 254, 1497-1500, the disclosures of which are herein incorporated by reference. Modified polynucleotides may also contain one or more substituted sugar groups. In one aspect, a modification of the sugar includes Locked Nucleic Acids (LNAs) in which the 2'-hydroxyl group is linked to the 3' or 4' carbon atom of the sugar ring, thereby forming a bicyclic sugar group. The linkage is in certain aspects a methylene ($—CH_{[2]}—$)$_{[n]}$ group bridging the 2' oxygen atom and the 4' carbon atom wherein n is 1 or 2. LNAs and preparation thereof are described in WO 98/39352 and WO 99/14226, the disclosures of which are incorporated herein by reference. In the present invention, preferably, the antisense oligonucleotide comprises a modified polynucleotide backbone. The modified polynucleotide backbone may comprise a modified moiety substituted for the sugar of at least one of the polynucleotides. The modified moiety may be selected from the group comprising of phosphorodiamidate morpholino oligomer (PMO), peptide-conjugated phosphorodiamidate morpholino oligomer (PPMO), and non-peptide dendrimeric octaguanidine moiety-tagged morpholino oligomer.

In various embodiments, the modified polynucleotide backbone comprises at least one modified internucleotide linkage. The modified internucleotide linkage comprises a modified phosphate. More preferably, the modified phosphate is any one selected from the group comprising of a non-bridging oxygen atom substituting a sulfur atom, a phosphonate, a phosphorothioate, a phosphodiester, a phosphoromorpholidate, a phosphoropiperazidate and a phosphoroamidate.

In various embodiment of the invention, the antisense oligonucleotide comprises a backbone selected from the group comprising of ribonucleic acid, deoxyribonucleic acid, DNA phosphorothioate, RNA phosphorothioate, 2'-O-methyl-oligoribonucleotide and 2'-O-methyl-oligodeoxyribonucleotide, 2'-O-hydrocarbyl ribonucleic acid, 2"-O-hydrocarbyl DNA, 2'-O-hydrocarbyl RNA phosphorothioate, 2'-O-hydrocarbyl DNA phosphorothioate, 2'-F-phosphorothioate, 2'-F-phosphodiester, 2'-methoxyethyl phosphorothioate, 2-methoxyethyl phosphodiester, deoxy methylene(m-ethylimino) (deoxy MMI), 2'-O-hydrocarby MMI, deoxymethylphos-phonate, 2'-O-hydrocarbyl methylphosphonate, morpholino, 4'-thio DNA, 4'-thio RNA, peptide nucleic acid, 3'-amidate, deoxy 3'-amidate, 2'-O-hydrocarbyl 3'-amidate, locked nucleic acid, cyclohexane nucleic acid, tricycle-DNA, 2'fluoro-arabino nucleic acid, N3'-P5' phosphoroamidate, carbamate linked, phosphotriester linked, a nylon backbone modification and mixtures of the aforementioned backbones.

The length of the antisense oligonucleotide (i.e., the number of nucleotides therein) is not critical so long as it binds selectively to the intended location, and can be determined in accordance with routine procedures. In general, the antisense oligonucleotide will be from 8, 10 or 12 nucleotides in length up to 20, 30, or 50 nucleotides in length. Antisense oligonucleotides which do not activate RNase H can be made in accordance with known techniques. See, e.g., U.S. Pat. No. 5,149,797 to Pederson et al. (The disclosures of all patent references cited herein are to be incorporated herein by reference). Such antisense oligonucleotides, which may be deoxyribonucleotide or ribonucleotide sequences, simply contain any structural modification which sterically hinders or prevents binding of RNase H to a duplex molecule containing the oligonucleotide as one member thereof, which structural modification does not substantially hinder or disrupt duplex formation. Because the portions of the oligonucleotide involved in duplex formation are substantially different from those portions involved in RNase H binding thereto, numerous antisense oligonucleotides which do not activate RNase H are available. For example, such antisense oligonucleotides may be oligonucleotides wherein at least one, or all, of the internucleotide bridging phosphate residues are modified phosphates, such as methyl phosphonates, methyl phosphonothioates, phosphoromorpholidates, phosphoropiperazidates and phosphoramidates. For example, every other one of the internucleotide bridging phosphate residues may be modified as described. In another non-limiting example, such antisense oligonucleotides are oligonucleotides wherein at least one, or all, of the nucleotides contain a 2' loweralkyl moiety (e.g., Cl-C4, linear or branched, saturated or unsaturated alkyl, such as methyl, ethyl, ethenyl, propyl, 1-propenyl, 2-propenyl, and isopropyl). For example, every other one of the nucleotides may be modified as described. See also P. Furdon et al., Nucleic Acids Res. 17, 9193-9204 (1989); S. Agrawal et al., Proc. Natl. Acad. Sci. USA 87, 1401-1405 (1990); C. Baker et al., Nucleic Acids Res. 18, 3537-3543 (1990); B. Sproat et al., Nucleic Acids Res. 17, 3373-3386 (1989); R. Walder and J. Walder, Proc. Natl. Acad. Sci. USA 85, 5011-5015 (1988).

In various embodiment, the antisense oligonucleotides of the present invention are steric hindrance antisense oligonucleotides (stAONs). The stAONs of the present invention are designed to induce splicing events. These include modulate alternative splicing by, without limitation, (1) one or more (consecutive or non-consecutive) exon exclusions; (2) one or more (consecutive or non-consecutive) exon inclusions; (3) selection of the proximal exon between a pair of mutually exclusive exons; (4) selection of the distal exon between a pair of mutually exclusive exons; (5) use of the proximal alternate 5' splice site for one or more exons; (6) use of the distal alternative 5' splice site for one or more exons; (7) use of splice site between the proximal and distal alternate 5' splice sites for one or more exons; (8) use of the proximal alternate 3' splice site for one or more exons; (9) use of the distal alternate 3' splice site for one or more exons; (10) use of splice site between the proximal and distal alternate 3' splice sites for one or more exons; (11) retention of one or more introns; (12) restoration of one or more introns; (13) use of alternate or competing translation start codons (AUG) that reside within an exon or over multiple exons; (14) use of alternate or competing termination codons (UAG, UAA and UGA) that reside within an exon or over multiple exons; (15) use of alternate or competing polyadenylation sites (e.g. but not limited to AAUUAAA, UGUAA and their degenerate versions) that can reside within an exon, over multiple exons, with an intron or over multiple introns; (16) circular- or back-splicing of one exon; (17) circular- or back-splicing of two or more consecutive exons which may include one or more introns with each intron flanked by a pair of consecutive exons therein; and/or (18) linear-splicing of circular RNA encompassing one or more consecutive exons.

Without loss of generality, the non-limiting alternative splicing patterns as described apply to both coding and non-coding exons, which include exons and introns at the 5' and 3' UTRs, and to non-coding RNAs, which include long non-coding RNAs (lncRNAs). The stAONs can be substituted with other form of reagents, for example, CRISPR/CAS system sgRNAs (single-stranded guide RNAs), to modulate one or more of the alternative splicing patterns as described.

The sequences of the genes that were targeted in the present invention are as follows:

| SEQ ID 1 | APAF1_gDNA | APAF1 gene |
| SEQ ID 2 | BAG4_gDNA | BAG4 gene |
| SEQ ID 3 | BCLAF1_gDNA | BCLAF1 gene |
| SEQ ID 4 | BIN1_gDNA | BIN1 gene |
| SEQ ID 5 | BIRC5_gDNA | BIRC5 gene |
| SEQ 1D6 | BMF_gDNA | BMF gene |
| SEQ 1D7 | CASP10_gDNA | CASP10 gene |
| SEQ ID 8 | EED@ENSG00000074266.17_gDNA | EED gene |
| SEQ ID 9 | KAT6A@ENSG00000083168.9_gDNA | KAT6A gene |
| SEQ ID 10 | KRBOX4_gDNA | KRBOX4 gene |
| SEQ ID 11 | MCL1_gDNA | MCL1 gene |
| SEQ ID 12 | NR1H2_gDNA | NR1H2 gene |
| SEQ ID 13 | PRKAB2_gDNA | PRKAB2 gene |
| SEQ ID 14 | ZNF304_gDNA | ZNF304 gene |
| SEQ ID 15 | ZNF548_gDNA | ZNF548 gene |

Table 1A below shows the sequences of those AONs used to target the genes above.

TABLE 1A

| Gene | Splice-event | Target splice-event sequence (5'-3') | stAON/gapmer ID | stAON/gapmer sequence (5' to 3') |
|---|---|---|---|---|
| APAF1 | ES | SEQ ID NO. 16:<br>cttttgacattcatactagtggcctatt<br>gggagaaatccacacgggccatca<br>cagcaccatccagtactgtgacttctc<br>cccacaaaaccatttggcagtggttg<br>ctttgtcccagtactgtgtagag | 363 | SEQ ID NO. 17:<br>UUU GUG GGG AGA<br>AGU CAC AGU ACU<br>GGA UG |
| | NMD | SEQ ID NO. 18:<br>gtctctcttgatcttggatgatgtttggg<br>actcttgggtgttgaaagcttttgacag<br>tcagtgtcagattcttcttacaaccaga<br>gacaagagtgttacagattcagtaatgg | 635 | SEQ ID NO. 19:<br>UCA ACA CCC AAG<br>AGU CCC AAA CAU<br>CAU CC |
| BAG4 | ES | SEQ ID NO. 20:<br>gagcagccaccatatcctagctaca<br>attctaactattggaattctactgcgag<br>atctagggctccttacccaagtacata<br>tcctgtaagaccagaattgcaaggccag | 364 | SEQ ID NO. 21:<br>UAG UUA GAA UUG<br>UAG CUA GGA UAU<br>GGU GGC |
| | RNaseH | SEQ ID NO. 22:<br>aaccctggaatgaccctgccccatta<br>tccttatggagatggtaatcgtagtgtt<br>ccacaatcaggaccgactgtacgac<br>cacaagaagatgcgtgggcttctcct<br>ggtgcttatggaatgggtggccgttat<br>ccctggccttcatcagcgccctcagc<br>accacccggcaatctctacatgactg<br>aaagtacttcaccatggcctagcagt<br>ggctctccccagtcaccccccttcacc<br>cccagtccagcagcccaag | 637<br>(Gapmer) | SEQ ID NO. 23:<br>GCA TCT TCT TGT<br>GGT CGT ACA GTC<br>GGT CCU GA |
| BCLAF1 | ES | SEQ ID NO. 24:<br>tttcgaattagaggcagaggaagag<br>ccagaggagttttgctgggacaaat<br>actggtccaaacaactcaaatactac<br>ttttcaaaagagaccgaaggaagag | 365 | SEQ ID NO. 25:<br>GUA UUU GAG UUG<br>UUU GGA CCA GUA<br>UUU GU |

TABLE 1A-continued

| Gene | Splice-event | Target splice-event sequence (5'-3') | stAON/ gapmer ID | stAON/gapmer sequence (5' to 3') |
|---|---|---|---|---|
| | | gaatgggatccagaatataccccaa agagcaagaagtacttcttg | | |
| | 5ASS (L --> S) | SEQ ID NO. 26: tacagtgaatgcaatccagagttact atcctcttctttgcttattcgcaggttcac agatgaagagtctagagtattcctgct tgatagggtaataccagggataaa gaggcttcaaaagagaaaggatca | 684 | SEQ ID NO. 27: UCU AGA CUC UUC AUC UGU GAA CCU GCG AAU AA |
| | 5ASS (S --> L) | SEQ ID NO. 28: gagaaagggagggcagagggag aatgggaagatcaggaagctctaga ttacttcagtgataaagagtctggaaa acaaaagtttaatgattcagaagggg atgacacagaggagacagaggatt atagacagttcaggaagtcagtcctc gcagatcagggtaaaagttttgctact gcatctcaccggaatactgaggagg aaggactcaagtacaagtccaaagt ttcactgaaaggcaatagagaaagt gatggatttagagaagaaaaaaatt ataaacttaaagagactggatatgta gtggaaaggcctagcactacaaaa gataagcacaaagaagaagacaa aaattctgaaagaataacagtaaag aaagaaactcagtcacctgagcag gtaaagtctgaaaagctcaaagacc tctttgattacagtccccctctacacaa gaatctggatgcacgagaaaagtct accttcagagaggaaagcccactta ggatcaaaatgatagcgagtgattct caccgtcctgaagtcaaactcaaaat ggcacctgttcctcttgatgattctaacag | 685 | SEQ ID NO. 28: UGU AGA GGG GGA CUG UAA UCA AAG AGG UCU |
| | NMD | SEQ ID NO. 29: gaattcgaatttagagtttaatttctcag agcattctctccaggaagaattttac agtatctcaaagacttcacttgacttctt gatcctgcataaaaccaag | 639 | SEQ ID NO. 30: AAA UUC UUC CUG GAG AGA AUG CUC UGA GAA AUU A |
| BIRC5 | ES(1) | SEQ ID NO. 31: tgggccgggcacggtggcttacgcct gtaataccagcactttgggaggccg aggcgggcggatcacgag | 366 | SEQ ID NO. 32: CAA AGU GCU GGU AUU ACA GGC GUA AGC |
| | ES(2) | SEQ ID NO. 33: agaggaacataaaaagcattcgtcc ggttgcgctttcctttctgtcaagaagc agtttgaagaattaaccttggtgaatt tttgaaactggacagagaaagagcc aagaacaaaatt | 367 | SEQ ID NO. 34: AGC GCA ACC GGA CGA AUG CUU UUU AUG |
| | NMD | SEQ ID NO. 35: atgccgaggctggcttcatccactg ccccactgagaacgagccagacttg gcccagtgtttcttctgcttcaaggagc tggaaggctgggagccagatgacg accccat | 640 | SEQ ID NO. 36: CGU UCU CAG UGG GGC AGU GGA UG |
| BMF | ES(1) | SEQ ID NO. 37: ctgggcttttcctcttcccaatcga gtctgggcgtccagccccgagtgct cgtcacgctggaccctggcgcggag ccctggcatcacgactcggaggccg agactctcctggagtcacccag | 694 | SEQ ID NO. 38: CGU GAC GAG CAC UCG GGG |
| | ES(2) | SEQ ID NO. 39: gtaccctgcatgcatatagctgctgatt ctactcctgctattgctcacaaccctca gagtcaaactttgtgaccggcctag | 695 | SEQ ID NO. 40: AUA GCA GGA GUA GAA UCA GCA GCU AUA |
| | A3SS (S --> L) | SEQ ID NO. 41: gcaatgctggctatcggcttcctctcc ctgccagtttcccagcagtcttgccca ttggggagcagcccccccgaagggc | 371 | SEQ ID NO. 42: UUU CGG GCA AUC UGU ACC UCU GCU UGA U |
| | A3SS (L --> S) | agtggcaacatcaagcagaggtac agattgcccgaaagcttcagtgcatt gcagaccagttccaccggcttcatgt gcagcaagtaggcacgggggtttag gggaggagggttgagtctgctgggg cttgggg | 372 | SEQ ID NO. 43: CUA CUU GCU GCA CAU GAA GCC GGU GGA ACU G |
| | NMD | SEQ ID NO. 44: gagagatggagccatctcagtgtgtg gaggagctggaggatgatgtgttcca accagaggatggggagccggtgac | 641 | SEQ ID NO. 45: UCC UCU GGU UGG AAC ACA UCA UC |

TABLE 1A-continued

| Gene | Splice-event | Target splice-event sequence (5'-3') | stAON/ gapmer ID | stAON/gapmer sequence (5'to 3') |
|---|---|---|---|---|
| | | ccaacccgggagcttgctctctgctg acctgtttgcccagagcctactggact gccccctcagccgacttcagctcttcc ctctcacccactgctgtggccctggcc ttcgacccaccagccaggaagaca aagctacccagactctcagcccagc ctcccccagccaaggtgtcatgctgc cttgtggggtgactgaggaacccca gcgactcttttatg | | |
| CASP10 | ES(1) | SEQ ID NO. 46: caggagtcctggcaaaataagcatg caggtagtaatg | 373 | SEQ ID NO. 47: AUU ACU ACC UGC AUG CUU AUU UUG CCA GG |
| | ES(2) | SEQ ID NO. 48: gtaacagagccacaaatggtgcacc aagcctggtctccaggggatgcaa ggagcatctgctaacactctaaactct gaaaccagcacaaag | 374 | SEQ ID NO. 49: AGA GUU UAG AGU GUU AGC AGA UGC UCC UU |
| | ES(3) | SEQ ID NO. 50: gacagagtgagactccgtaaaaaa aaattttgttttcttctttgttgcagacatg aagacatcttatccatcctcactgctgt caacgatgatgtgagtcgaagagtg gacaaacagggaacaaagaaaca gatgccccagcctgctttcacactaa ggaaaaaactagtattccctgtgccc ctggatgcactttcattatagcagaga gttttgttggtcttagacctcaaacga atcattggctataacctccagcctcct gcccagcacaggaatcggtggtctc cacctgtcattctagaaacaggaaac accgtgttttctgacacagtcaattctg attttcttttcttttgcaagtctaaatgtta gaaaactttcttttttttggagatagtctc attctgtcacccagactggagtgcag gggggcaatcacggctcactgtagtc tcgacctcccaggctcaagctgtcctc ccgcctcagcttcccaagtagctggg accacaggtgtgtaccaccgtgccc ggatttttttattctttattttttgtagagat ggagggatctcactttgttgcacagg ctggtttcaaactcctaggcccaagtg atcctcccacctctgtccccaaaatac tgggattataggcacgagccaccac acctggccagaaaactttcattattga agacttggattgtagccttggttttggat gtctattctgaagacagagtaattggc tttggtttgtgcaggtacttttctttgaga cagagtcactccgtcacctgggctgg agtgcagtggtgggatcactgttcact gcagccttgacctcccaggttcaagc gatcctcccacctcagcctcccaagt agctgagactacaggtgtgtgtccat gcacagctaacttttatttttttgtgga gatggggtttcactatgttgcctaagct ggtctcaaactcctgggctcaagcga tcctcccacctcagcttctcaaagttct gggactacaggcatgaaatactgtg cctggcctggggaccaggtgcattta aggttccttggtgttcaaaaaccacgt tcttagcctagattgagcttagattgcc tctctagacaactacccccttagttataa ttctgtgtccctctgcatgcccttaaa cattggacagtgaggtcacagtccac ccaccctctctctgatctcccccttcct aagacttctcttttgcacatctagtgag gtgaaaatttggtctatgccaggccc atttcctgcttttgtgtaaggaaggtgct cacataggaagtttttatttggttagag acaggtttccctgtaggaagatgatg gctcatttacactcagctgctctgcaa gcagaaactttacaacctgatgtcat attccattttggactgggtgcggtgact catgcctgtaatcccagtactctggga agccaaggcaggcagatcacttga ggtcaggagttcgagaccagcctgg | 709 | SEQ ID NO. 51: UGG AUA AGA UGU CUU CAU GUC UGC AAC AAA GA |

TABLE 1A-continued

| Gene | Splice-event | Target splice-event sequence (5'-3') | stAON/ gapmer ID | stAON/gapmer sequence (5'to 3') |
|---|---|---|---|---|
| | | ccaatacggcaaaacctcatcattac | | |
| | | taaaaacacaaaaattagccaggtg | | |
| | | tggcggcgagcacctgtaatcccag | | |
| | | ctactcgggaggctgagacaggag | | |
| | | aatctcttgaatccaggaggcagag | | |
| | | gctgtggtgagccaagatgacacaa | | |
| | | ctgcactccagcttgggcaacaggg | | |
| | | cgagaccttgtttaaaaaaaaattc | | |
| | | aatattggggttggaacatttcagttgc | | |
| | | cattgacagaacacccaattcaaatt | | |
| | | gactgaagcaaagaagggaatttatt | | |
| | | gcctctttcacattgaaacccaggagt | | |
| | | ggataacactggcttcaggcaaagc | | |
| | | ttgaatcaggactcaatctacaggcc | | |
| | | agcacctttctcttggccggatgtcctc | | |
| | | agggctggcagatgcagtagactgc | | |
| | | agtggacagtccccaccttgttactgc | | |
| | | tactacactttgctcctctggcccaag | | |
| | | gcatgaggagagaggctgtgtcaga | | |
| | | aactgaagctgttctcaggatcactg | | |
| | | ggctcttcttggcagaggggatgtctg | | |
| | | gcttgcctgaagggagtggctctgta | | |
| | | aggacgccttgatgctttcttcattaag | | |
| | | attttgagcatttttacgtacttgagctttt | | |
| | | ttttttttttttttcaatttctagaggaacttt | | |
| | | tctctgttaattcctggaactgtattttga | | |
| | | atccttaaaggtgagccctcataggg | | |
| | | agatccaaagtcctgtggttaacgcct | | |
| | | tcatttatagatgaggcagctgaggc | | |
| | | ctggggatgtgaacaacctgctcaca | | |
| | | gtcctcatttactggatttgacttcagcc | | |
| | | aggtgaactggaatgccttggggcgt | | |
| | | ggaagggcattaggagtgtttcatttg | | |
| | | atatgtgaatgctcataaaaaaatgtc | | |
| | | aaggaatgaagaacaacaactctc | | |
| | | agtggtgcctgcatttataattatttatgt | | |
| | | gaaagtcaaattcatgtacagtaaatt | | |
| | | tgttataagaatattcacaagaacact | | |
| | | gttctgatatctctgattgtcatgtggatt | | |
| | | tgaatgtagcttgacagagggaatgt | | |
| | | ctaatctatattgacagggcaggaac | | |
| | | accgtcatcttagacaaacaccgcc | | |
| | | actttaagttccagttcccttttctagcct | | |
| | | catgcatttcaaggaaatcacttcttttc | | |
| | | taacagcgagcagccagaaagag | | |
| | | aagagagtaaaatacagataagac | | |
| | | agctctggcatagagggaggtgggg | | |
| | | gggtggggaagtctcttgggtaact | | |
| | | gccaaactttgccttcatacaatgggtt | | |
| | | ccaggaaaacaatgagccttaataa | | |
| | | gcacattcctttcccttcaggtgcacta | | |
| | | agtggggaagctaaaagcagactg | | |
| | | gaggggggtggggtgtacctacagc | | |
| | | tgcagaaatattgtatgggaacggac | | |
| | | acacaactctccctcccagataagc | | |
| | | acagcaaagagacatagaagcaat | | |
| | | ccaagcctctgataaactctcccacc | | |
| | | ctaaatccttaaaaactcttagtctgta | | |
| | | agtgagtgggctctgacctaactcgg | | |
| | | ccagaagcccctttcaaatttgttttctc | | |
| | | taaaataaacctgtccttggctgtcaa | | |
| | | gccacctttcatgtttctttcctctttcttta | | |
| | | attcttacacatgtgtcaggatgatctc | | |
| | | ccaaaaccgtgttcataacagtcagg | | |
| | | gccaaaagctagtggtcacagtcctt | | |
| | | gtccagttggcagaactgacatgtga | | |
| | | aggcaagtgaaggatggtgagatac | | |
| | | tgaggaaagagcaaaggatctgga | | |
| | | gatcaaagccctgcatttccattttgtc | | |
| | | ctgattcctttgctcagagacactaact | | |
| | | aaatcaagctagcttttttcagccttgtc | | |
| | | tgtaaagtagagaaaacattagctgtt | | |
| | | gggaagacgaaaaagaatgtgtcct | | |
| | | atgtgtgcatctatttaaatctaactgtg | | |
| | | ctgaggtgcatataaatgcctttaggt | | |
| | | ggtagggtcttccggttgtaactgcaa | | |

TABLE 1A-continued

| Gene | Splice-event | Target splice-event sequence (5'-3') | stAON/gapmer ID | stAON/gapmer sequence (5' to 3') |
|---|---|---|---|---|
| | | cagaaatagcaggacttaagttcctttgtgcgtaattccagctgactttattagcggcaactcagcactagcattaccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatccagatggctgaagtaactgaagaatcacaaagaagtgaaaatggcctgttcctgccttaactgatgacattaccttgtgaaattccttctcctggctcatcctggctcaaaagctccccccagtgagcaccttgtgaccccccatccctgccagccagagaacaaccccctttgactgtaattttccactacttacccaaatcctataaaacggccccacccctatctcccttcactgacttttcttttcggactcagcccacctgcacccaggtgattaaaaagctttattgctcacacaaagcctgtttggttgtctcttcacaaggacgcgagtgaaacctcctt | | |
| | ES(4) | SEQ ID NO. 52: aaaaaaccactcagtcaaagttcccctttttattctctttgtgctcagtaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcctgagattgacaacgcctacagcaagacggaaacctccctttacagcaccaccttgcgattctgcagccacaaagttgagacttctgaacgtggcactcttctgttccctactgtttcacgtgtacctgtgtcatctttcttgtttcatcgtaaacatacttctaaaattcccatttctttatttagaaatagaactacaagcggatggttaaacaatttaaacaaatggtccatggggaaaagtgaatttcacactgtccccaaactttcagtg | 710 | SEQ ID NO. 53: UCC AGA AAU UUC AGC AUC CUA CUG AGC ACA AA |
| | NMD | SEQ ID NO. 54: aaacctgctctacgaactgtcagaaggcattgactcagagaacttaaaggacatgatcttccttctgaaagactcgcttcccaaaactgaaatg | 642 | SEQ ID NO. 55: UCU CUG AGU CAA UGC CUU CUG ACAGU |
| BIN1 | ES(1) | SEQ ID NO. 56: ctccggaaaggcccaccagtccctccgcctcccaaacacaccccgtccaaggaagtcaagcaggagcagatcctcagcctgtttgaggacacgtttgtccctgagatcagcgtgaccacccccctcccag | 518 | SEQ ID NO. 57: UUG ACU UCC UUG GAC GGG GUG UG |
| | ES(2) | SEQ ID NO. 58: ccagcagaggcctcggaggtggcgggtgggacccaacctgcggctggagcccaggagccaggggagacggcggcaagtgaagcagcctcc | 519 | SEQ ID NO. 59: UCC AGC CGC AGG UUG GGU C |
| | NMD | SEQ ID NO. 60: gccgaggaggagctcatcaaagcccagaaggtgtttgaggagatgaatgtggatctgcaggaggagctgccgtccctgtggaacag | 645 | SEQ ID NO. 61: AUC CAC AUU CAU CUC CUC AAA CAC CUU CU |
| MCL1 | ES | SEQ ID NO. 62: gcttgggggccggcagcggcggcgccaccccgcccggggaggcgacttttggctacggagaaggaggcctcggcccggcgagagatagggggaggggaggccggcgcggcggtgattggcggaagcgcggcgcaagcccccccgtccacccctcacgccagactcccggagggtcgcgcggccgccgcccattggcgccgaggtccccgacgtcaccgcgacccccgcgaggctgctttttcttcgcgccca | 653 | SEQ ID NO. 63: UAU CUC UCG CCG GGC CG |

TABLE 1A-continued

| Gene | Splice-event | Target splice-event sequence (5'-3') | stAON/ gapmer ID | stAON/gapmer sequence (5' to 3') |
|---|---|---|---|---|
| | | cccgccgcgcggcgccgcttgagg agatggaagcccggccgctgacg ccatcatgtcgcccgaagaggagct ggacgggtacgagccggagcctctc gggaagcggccggctgtcctgccgc tgctggagttggtcggggaatctggta ataacaccagtacggacgggtcact accctcgacgccgccgccagcaga ggaggaggaggacgagttgtaccg gcagtcgctggagattatctctcggta ccttcgggagcaggccaccggcgc caaggacacaaagccaatgggca ggtctggggccaccag | | |
| | IR | SEQ ID NO. 64: gcgcaaccctccggaagctgccgcc cctttccccttttatgggaatactttttta aaaaaaaagagttcgctggcgcca ccccgtaggactggccgccctaaaa ccgtgataaaggagctgctcgccact tctcacttccgcttccttccagtaagga gtcgggtcttccccagttttctcagcc aggcggccggcggcgactggcaatg tttggcctcaaaagaaacgcggtaat cggactcaacctctactgtgggggg ccggcttgggggccggcagcggcg gcgccacccgcccgggagggcga cttttggctacggagaaggaggcctc ggcccggcgagagataggggag gggaggccggcgcggtgattggcg gaagcgccggcgcaagcccccgt ccaccctcacgccagactcccggag ggtcgcgcggccgccgcccattggc gccgaggtccccgacgtcaccgcg accccgcgaggctgcttttcttcgcg cccaccccgccgcgcggcgccgcttg aggagatggaagcccggccgctg acgccatcatgtcgcccgaagagga gctggacgggtacgagccggagcct ctcgggaagcggccggctgtcctgc cgctgctggagttggtcggggaatct ggtaataacaccagtacggacgggt cactaccctcgacgccgccgccagc agaggaggaggaggacgagttgta ccggcagtcgctggagattatctctcg gtaccttcgggagcaggccaccggc gccaaggacacaaagccaatgggc aggtctggggccaccagcaggaag gcgctggagaccttacgacgggttg gggatggcgtgcagcgcaaccacg agacggccttccaag | 654 | SEQ ID NO. 65: CCU CCU UCU CCG UAG CCA AAA GU |
| | RNaseH | SEQ ID NO. 66: agttgtaccggcagtcgctggagatt atctctcggtaccttcgggagcaggc caccggcgccaaggacacaaagc caatgggcaggtctggggccaccag caggaaggcgctggagaccttacg acggttgggatggcgtgcagcgc aaccacgagacggccttccaag | 652 (Gapmer) | SEQ ID NO. 67: CUU GGA AGG CCG TCT CGT GGT TGC GCT GCA |
| NR1H2 | ES | SEQ ID NO. 68: tcatcccagatcccgaagaggaacc agagcgcaagcgaaagaagggcc cagccccgaagatgctgggccacg agctttgccgtgtctgtgggacaag gcctccggcttccactacaacgtgctc agctgcgaaggctgcaagggcttctt ccggcgcagtgtggtccgtggtggg gccaggcgctatgcctgccggggtg gcggaacctgccagatggacgctttc atgcggcgcaagtgccagcagtgcc ggctgcgcaagtgcaaggaggcag ggatgagggagcagt | 377 | SEQ ID NO. 69: UCU GGU UCC UCU UCG GGA UCU GGG |
| | NMD | SEQ ID NO. 70: gcgtcctttctgaagaacagatccgg aagaagaagattcggaaacagcag caggagtcacagtcacagtcgcagt cacctgtggggccgcagggcagca | 656 | SEQ ID NO. 71: GUU UCC GAA UCU UCU UCU UCC GGA UCU GUU C |

TABLE 1A-continued

| Gene | Splice-event | Target splice-event sequence (5'-3') | stAON/gapmer ID | stAON/gapmer sequence (5'to 3') |
|---|---|---|---|---|
| | | gcagctcagcctctgggcctgggggct tccctggtggatctgaggcaggcag ccagggctccggggaaggcgagg gtgtccagctaacagcggctcaaga actaatgatccagcagttggtggcgg cccaactgcagtgcaacaaacgctc cttctccgaccagcccaaagtcacg | | |
| ZNF548 | ES | SEQ ID NO. 72: gtgggctctgtgttgagagaacaggg ggctgagacttgggggccagaccat tggtggctccacagacatcatactctg tccagaacggtgcagacctggcata acagggattctggattgcatctgtaaa aagggaggcctggactgg | 772 | SEQ ID NO. 73: AAG UCU CAG CCC CCU GUU CUC UCAA |
| | | | 773 | SEQ ID NO. 74: CCU GUU CUC UCA ACA CAG AGC CCA |
| | EI | | 774 | SEQ ID NO. 75: GUU AGU AAC CAA AAC AGC AUG GUA AUG GAU AGA AA |
| | | | 775 | SEQ ID NO. 76: UAA GGU GUA CAG CUC AGU GGU AAA GCA UUU GA |
| | | | 776 | SEQ ID NO. 77: AAC AGA GAG UGG CCC UGA GGG UCAA |
| | NMD | SEQ ID NO. 78: aatggagttgggaagtcagcataa agagcagatttccgggagaagatca caggttggattttggacatggtgattct caaatgtctcaagatggatatgtcac acagacaggtggacataaag | 1151 | SEQ ID NO. 79: CAU GUC CAA AAU CCA ACC UGU GAU CUU CUC CC |
| | | SEQ ID NO. 80: ggccgtgtggtctttgaggacgtggc catatatttctcccaggaggagtggg ggcaccttgatgaggctcagagattg ctgtaccgtgatgtgatgctggagaat ttggccctttttgtcctcactag | 1152 | SEQ ID NO. 81: CUG GGA GAA AUA UAU GGC CAC GUC CUC AA |
| PRKAB2 | ES | SEQ ID NO. 82: ataaagaaactaaggctcagagaa ggtcaaattgcca | 760 | SEQ ID NO. 83: AUU UGA CCU UCU CUG AGC CUU AGU UUC UUU |
| | EI | | 761 | SEQ ID NO. 84: UUU UUA AGU GUU AUA UUG UAC CAC AUA GUU UGU UA |
| | | | 762 | SEQ ID NO. 85: AAA CCU ACU UGG AAA GAC CUG GCA UAA UGA UAA UA |
| | | | 763 | SEQ ID NO. 86: AAA GCC UAA AUA CGA CAG AAG CAA GGC AGG UAA AC |
| | | | 764 | SEQ ID NO. 87: AAA AAA AUU AUA GGG CCC AUC CUA GAU GCA CUU AU |
| | | | 765 | SEQ ID NO. 88: AUC CAG CUA UAU AUC CAA GUA AAA GCA GCU AA |
| | NMD | SEQ ID NO. 89: gtggtccccgacgagctgcagccat gggaaacaccaccagcgaccgggt gtccggggagcgccacggccgcaa ggctgcacgctccgagggcgcagg cggccatgccccggggaaggagca caagatcatggtggggagtacggac gaccccagcgtgttcagcctccctga ctccaag | 1149 | SEQ ID NO. 90: UGU UUC CCA UGG CUG CAG CUC G |
| | | SEQ ID NO. 91: ccataatgactttgttgccatcctggac ctccctgagggagagcaccaataca agttctttgtgatggacagtgggttca tgatccatcagag | 1150 | SEQ ID NO. 92: AGG UCC AGG AUG GCA ACA AAG UCA UUA |

TABLE 1A-continued

| Gene | Splice-event | Target splice-event sequence (5'-3') | stAON/ gapmer ID | stAON/gapmer sequence (5'to 3') |
|---|---|---|---|---|
| KAT6A | ES | SEQ ID NO. 93: gattctttctactaatccagatacttgttgaagtgctgactagtttcttggggaaagatgtcaaggaagagttgaaattcctagactggtgagcagagattgcggagtacagaatagccatcacccactctg | 913 | SEQ ID NO. 94: CUA GUC AGC ACU UCA ACA AGU AUC UGG AUU AGU |
| | EI | | 914 | SEQ ID NO. 95: UGA AAA GAA UGA AUA CAA UAU GCA CAC CCA GUU UAU A |
| | | | 915 | SEQ ID NO. 96: CAA UAU GCA CAC CCA GUU UAU AAU UUA AGU ACA GU |
| | | | 916 | SEQ ID NO. 97: UAU UCC AAA ACA AUC AUG UAU GUA AAC CAU UGG GAU AA |
| EED | ES | SEQ ID NO. 98: agtggccgtgccattttacattcccaccagcaatgtatgagagatccagtgtctccgaatcttcgccagcatttg | 900 | SEQ ID NO. 99: GGA UCU CUC AUA CAU UGC UGG UGG G |
| | EI | | 901 | SEQ ID NO. UUU ACC CAG AGA AAU GAA AAC UUA AG U CCA CAC AAA AAC C |
| | | | 902 | SEQ ID NO. 101 UAA UCC AUA CCA UGG AAU ACU ACU CAG CAA UAA AAA AGG A |
| | | | 903 | SEQ ID NO. 102 GGA UAU ACG AAU GGU AAA UAA GCA CAU GAA AAA GAU GUU C |
| | | | 904 | SEQ ID NO. 103: AGA UAU CAC UAC ACA CCU AUC AGA ACA GCU AAA AUA AAA A |
| | NMD | SEQ ID NO. 104: cactatgttggccatggaaatgctatcaatgagctgaaattccatccaagagatccaaatcttctcctgtcagtaagtaaag | 905 | SEQ ID NO. 105: GGA GAA GAU UUG GAU CUC UUG GAU GGA |
| | | SEQ ID NO. 106: atcatgctttacgattatggaatatccagacggacactctggtggcaatatttggaggcgtagaagggcacagagatgaagttctaagtgct | 906 | SEQ ID NO. 107: AGA GUG UCC GUC UGG AUA UUC CAU AAU CGU |
| ZNF304 | ES | SEQ ID NO. 108: gttgagaacagactgtgagcatgagggagcagctactgcagtagtgttgatggtgtctggtctagaggtgtggctgtggag | 766 | SEQ ID NO. 109: CAC ACC UCU AGA CCA GAC ACC A |
| | EI | | 767 | SEQ ID NO. 110: AAA CAU GAC CAA AGC CUA ACU CCU GAU AUA ACC AC |
| | | | 768 | SEQ ID NO. 111: UUC AUA AUU UUA CCA GCU ACA GCA AAA ACA AAC CA |
| | | | 769 | SEQ ID NO. 112: AAU CCU ACA AGC AUU UGA GCG UAC CUG UUC |
| | | | 770 | SEQ ID NO. 113: ACC UUU CGC AUC AAA AAA UCC AAU CAC CCU ACU U |
| | | | 771 | SEQ ID NO. 114: UCC AAA UCU CCC ACG ACU UUU ACC |

TABLE 1A-continued

| Gene | Splice-event | Target splice-event sequence (5'-3') | stAON/gapmer ID | stAON/gapmer sequence (5'to 3') |
|---|---|---|---|---|
| | NMD | SEQ ID NO. 115:<br>gtgggctctgtgttgagagaacaggg<br>ggctgagacttgggggccagaccat<br>tggtggctccacagacatcatactctg<br>tccagaacggtgcagacctggcata<br>acagggattctggattgcatctgtaaa<br>aagggaggcctggactgg | 896 | SEQ ID NO. 116:<br>CCG AGA GAA GUA<br>CAC GAA CAC A |
| | | | 897 | SEQ ID NO. 117:<br>AGC CAC AAG UGC<br>AAA GUU CUC CAG<br>CAU C |
| KRBOX4 | ES | SEQ ID NO. 118:<br>atgtatccatttttgcctcatgtattttga<br>agtgctgttattag | 754 | SEQ ID NO. 119:<br>AAG UGU AUG UAC<br>CUA AUA ACA GCA<br>CUU CAA |
| | | | 755 | SEQ ID NO. 120:<br>UAC AUG AGG CAA<br>AAA UGG AUA CAU<br>CUG AAA GAG A |
| | EI | | 756 | SEQ ID NO. 121:<br>GGG GUG GGU<br>AGA GAG AGG UAU<br>AAG GAA A |
| | | | 757 | SEQ ID NO. 122:<br>CAG CAG AAU AUA<br>CAU UCU UUU CAA<br>GUG CAU AUG AA |
| | | | 758 | SEQ ID NO. 124:<br>ACA AGU AGA CAG<br>AAA ACC AGC AAG<br>GAU AUA GAU A |
| | | | 759 | SEQ ID NO. 124:<br>GGG AUG GAG AUA<br>UAC CAU GAA AAC<br>CUA ACC AAA |
| | NMD | SEQ ID NO. 124:<br>gaatcattgaccttcaaggacgtgttt<br>gtggacttcaccctggaggagtggc<br>agcaactggactctgcccagaagaa<br>cctctacagggatgtcatgcttgaga<br>actacagccacctggtgtccgtgg | 894 | SEQ ID NO. 126:<br>AGU CCA CAA ACA |
| | | | 895 | CGU CCU UGA AGG<br>UCA AUG AUU<br>SEQ ID NO. 127:<br>GGU UCU UCU<br>GGG CAG AGU CCA<br>GUU G |

In various embodiments, the splicing events may be any of the following:

a) One or more (consecutive or non-consecutive) exon exclusions;
b) One or more (consecutive or non-consecutive) exon inclusions;
c) Selection of the proximal exon between a pair of mutually exclusive exons;
d) Selection of the distal exon between a pair of mutually exclusive exons;
e) Usage of the proximal alternate 5' splice site for one or more exons;
f) Usage of the distal alternate 5' splice site for one or more exons;
g) Usage of splice site between the proximal and distal alternate 5' splice sites for one or more exons;
h) Usage of the proximal alternate 3' splice site for one or more exons;
i) Usage of the distal alternate 3' splice site for one or more exons;
j) Usage of splice site between the proximal and distal alternate 3' splice sites for one or more exons;
k) Retention of one or more introns;
l) Restoration of one or more introns;
m) Circular- or back-splicing of one or more consecutive exons; and
n) Linear-splicing of circular RNA encompassing one or more consecutive exons.

In some embodiments, the splice event is exon skipping, wherein exon skipping is induce by steric hinderance exerted by the antisense oligonucleotide. These antisense oligonucleotides exert a steric hindrance effect against one or more RNA-binding splicing regulators. For example, in various embodiments, the oligonucleotide may prevent translation of the mRNA by steric hindrance. Each stAON may be designed to bind to nascent mRNA complementarily at specific sites and exerts steric hindrance effects against RNA-binding splicing regulators, which are critical for exon recognition and its splicing. Mechanistically, when a stAON induces the exclusion of a specific out-of-frame exon that generates numerous downstream premature termination codons in the mature RNA, the resultant mRNA is targeted for degradation via the nonsense-mediated decay process.

The techniques for designing, selecting, and validating stAONs suitable for use in the present invention are available in PCT Publication No. WO 2011078797A2, which is hereby incorporated by reference in its entirety.

As used herein, "hybridisation" means an interaction between two or three strands of nucleic acids by hydrogen bonds in accordance with the rules of Watson-Crick DNA complementarity, Hoogstein binding, or other sequence specific binding known in the art. Hybridisation can be performed under different stringency conditions known in the art.

The level of stringency of hybridisation used can vary depending upon the level of sensitivity desired, a particular probe characteristic, such as probe length and/or annealing temperature, or degree of homology between probe sequence and sequence of interest. Therefore, considerations of sensitivity and specificity will determine stringency of hybridization required for a particular assay.

"Stringency" of hybridisation reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to re-anneal when complementary strands are present in an environment below their melting temperatures. The higher the degree of desired homology between the probe and hybridizable sequence, the higher the relative temperature that can be used. For additional details and explanation of stringency of hybridization reactions, see Ausubel et al. Current Protocols in Molecular Biology (Wiley Interscience Publishers, 1995) or Protocols Online URL: www.protocol-online.net/molbio/index.htm).

In an example, hybridisation may be performed in aqueous solution containing between 0.1×SSC and 6×SSC and at temperatures of between 55° C. and 70° C. It is well known in the art that the higher the temperature or the lower the SSC concentration the more stringent the hybridisation conditions. By "high stringency", it means 2×SSC and 65° C. 1×SSC is 0.15M NaCl/0.015M sodium citrate. AONs which hybridise at high stringency are included within the scope of the claimed invention.

In various embodiments, the method of the present invention may be carried out in a plate template having an array of wells. As such, the hybridisation of the first and second antisense oligonucleotides to a pre-mRNA of the target gene may be carried out in separate wells in a plate template. Examples of which will be shown later.

Figure 1B:
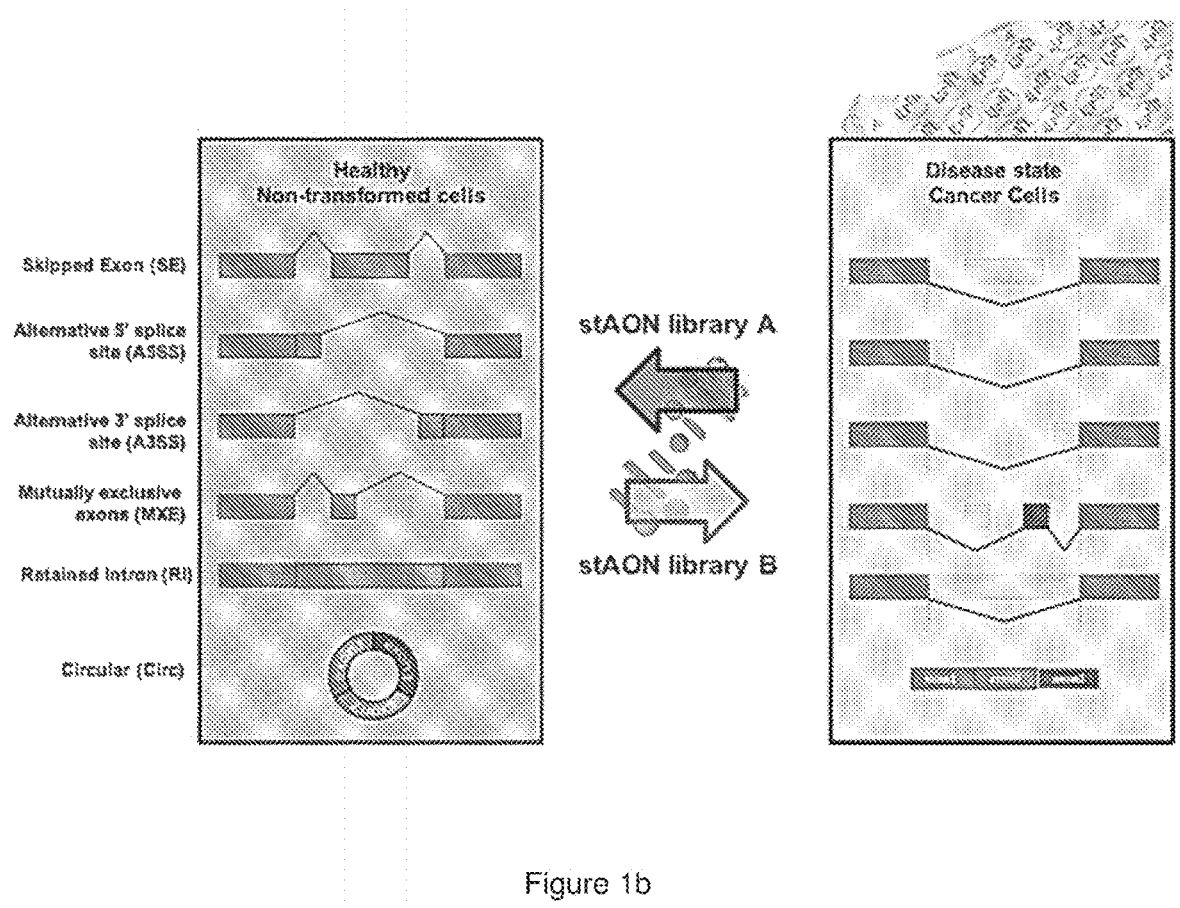

In various embodiments, the first and second splice events are opposing events, the first antisense oligonucleotide induces the splice event and a second antisense oligonucleotide reverses the splice event. In the example shown in FIG. 1a, a cell may have two or more states. State 1 may be a healthy state, and State 2 may be a diseased state. These two or more states may be dependent on isoforms expressed by a single target gene of interest. As is already understood, alternative splicing can result in different isoforms expressed by a single target gene in a cell. For ease of description, let us consider two isoforms that arise from alternative splicing of a single gene—Isoform A and Isoform B. Isoform A may be expressed in healthy cells (State 1), while Isoform B (when expressed) results in a diseased cell (State 2). FIG. 1b further illustrates the use of the AONs according to an embodiment of the present invention wherein the present invention includes a method of screening and characterise the effect of splice events have on the phenotype (based on the expression of isoforms) of the cell for a target gene.

As such, in the present invention, by "opposing events", it is meant to refer to the two or more states of a cell that can arise based on the expression of two or more isoforms that may be produced/expressed by a single target gene because of alternative splicing. Therefore, in a non-limiting embodiment of the present invention, the first antisense oligonucleotide induces a splicing event that results in the production of an isoform that leads to the expression of that isoform and results in said state of the cell (e.g. from State 1 to State 2), while the second antisense oligonucleotide induces the reverse, i.e. induces a splicing event that results in the production of an isoform that leads to the expression of an isoform that results in another state of the cell (e.g. from State 1 to State 2), the expression or the alternative splice event of at least one isoform of a gene observed in a healthy state cell is "switched" to the expression or the alternative splice event of at least one isoform of the gene observed in a diseased state cell, and vice versa; or the expression or the splice event of at least one isoform of a gene observed in both healthy and diseased states of a cell, cells before and after treatment with drugs and/or biological procedures or between different cell types, is increased, and vice versa.

Within the same group of cells, it may be possible for the same gene to have two or more different isoforms expressed. As such, in various embodiments, the method further comprises (a) providing a group of cells having two or more splicing variants or events of the target gene; and (b) hybridising the first antisense oligonucleotide to a pre-mRNA of the target gene and the hybridising the second antisense oligonucleotide to a pre-mRNA of the target gene expressed. Here, there is only a group of cells and a target gene expresses at least two isoforms. In this particular embodiment, the screen is known as a 2-way screen. This means that the method of the present invention switches the expression of the two isoform back and forth. The first antisense oligonucleotide induces a splicing event, while the second antisense oligonucleotides induces another splicing event on the same target gene within the same group of cells. The first antisense oligonucleotide switches the splice event of the target gene that expresses the first splicing variant towards the splice event that expresses the second splicing variant, and the second antisense oligonucleotide switches the splice event of the target gene that expresses the second splicing variant towards the splice even that expresses the first splicing variant.

In various embodiments, the method further comprises: (a) providing a first group of cells and a second group of cells, each group of cells has a different splicing variant or event of the target gene; and (b) hybridising the first antisense oligonucleotide to a pre-mRNA of the target gene expressed in the first group of cells, and the second antisense oligonucleotide to a pre-mRNA of the target gene expressed in the first group of cells. The different groups of cells selected may have known states, for example whether or not they are in healthy or diseased states. Thus, the experiments carried out based on the present invention allows for the characterisation of the splicing events vis-à-vis the expression of the different isoforms and, thus, the phenotype of the cells. The hybridisation for each group of cells may be carried out in separate wells in a plate template.

The sets of cells may be any different types of cells provided that they are suitable for the practice of the present invention. Likewise to what was described earlier in reference to the different states of the cells, non-limiting examples of such cell groups include cells in a healthy state (e.g. untransformed cells or naturally occurring cells) and in a diseased state (e.g. cancer cells), cells treated or untreated by a substance or drug (e.g. chemical or biological reagent) or procedure. There is no limit to the number of sets of cells used in the screening described herein.

In various embodiments, the first antisense oligonucleotide switches the splice event of the target gene expressed in the first group of cells towards the splice event of the second group of cells, and the second antisense oligonucleotide switches the splice event of the target gene expressed in the second group of cells towards the splice event of the first group of cells.

In various embodiments, the step of characterising the effect of the splicing variants comprises identifying/analysing/characterising the splicing variant expressed by the target gene based on detecting or observing the phenotype of the cells. In particular, the step of determining the effect of the splice event comprises detecting a phenotype of the cells expressed by the splice variant, detecting a phenotype of the cells not expressing the splice variant, detecting a phenotype of the cells not expressing the target gene in which the splice variant is derived from, and correlating the splice event with their relative expression in the at least two groups of cells. There can be many ways of identifying the protein isoforms. Methods such as northern and southern blotting techniques used in identifying expression of genes may be used. Alternatively, method such as the use of electrophoresis, antibodies and mass spectrometry analyses that are also well known in the art may be used.

In the present invention, the splicing variant or event may be identified by detecting a phenotype of the cells expressed by the splice variant, and correlating the splice event with their relative expression in the at least two groups of cells. The phenotype of the cells comprises detecting a characteristic of the cell selected from the non-limiting group consisting of cell morphology, cell viability, cell proliferation, cell death, cell cycle, cell migration, invasiveness or senescence, sensitivity to pharmacological or biological agents, or cellular, molecular, biochemical, metabolic, epigenetics or bioenergetics markers.

In various embodiments, the method further comprising providing and using a third antisense oligonucleotide for suppressing the expression of the target gene.

In various embodiments, the method further comprises providing at least one "inhibitory reagent" to inhibit, suppress or knockout the target gene; this reagent can act on the target gene's mRNA such as a stAON inducing nonsense-mediated decay, a siRNA, a shRNA, a gapmer inducing degradation of the target gene's mRNA via RNaseH-mediated degradation or RNAi, can act on the target gene's protein via chemical molecules, antibodies, peptides or aptamers, or can act on the target gene's DNA via DNA editing tools such as CRISPR/Cas sgRNA (guide RNAs). The reagent will contact with a group of cells to determine the effect on suppressing, inhibiting or knocking out the target gene. In the final step, the method comprise the comparison of the effect on cells between the "splice-switching stAON" and the inhibitory reagent. In various embodiments, the inhibitory reagent is contacted with the at least two groups of cells, each group of cells must express the target gene.

In some embodiments, the inhibitory reagent may be an antisense oligonucleotide that suppresses the expression of the target gene.

In various embodiments, the hybridisation of the first and second antisense oligonucleotides to a pre-mRNA of the target gene is carried out in separate wells in a plate template.

In various embodiments, the at least one antisense oligonucleotide is contacted with at least two groups of cells, each group of cells differ in the abundance of a specific splice event of the target gene. The inhibitory reagent is contacted with at least two groups of cells, each group of cells must express the target gene.

In alternative embodiments, the two groups of cells need not differ in the abundance of a specific splice event of the target gene. For instance, in a screen to identify synthetic lethal drug targets, the same antisense oligonucleotide may be contacted with the two groups of cells that do not differ in the abundance of a specific splice event of a target gene, hoping (or in the event) that one group of cell is considerably affected more when the splice event is either induced or reversed.

In various embodiments, the method further comprises providing a plurality of antisense oligonucleotides that are capable of inducing at least one splice event on one or more target genes.

In various embodiments, two or more stAONs having the same effect on a particular splicing variant of interest may be used, independently or in combination. In various embodiments, one stAON that can have an effect on more than one splicing event of a target gene may be used. In various embodiments, two or more stAONs with each having their respective effect on distinct splicing events of a target gene may be used in combination. In various embodiments, two or more stAONs with each having their respective effect on one or more splicing events of one or more target genes may be used in combination.

In various embodiments, the present method is a multiplex method that allows simultaneous determination of a number of different splicing variants or splicing events of one or more target genes. In an embodiment, the method is carried out 96-, 192- or 384-wells format plates and is capable of a high-throughput characterization of the therapeutic value and/or biological function of, from 10 to 1,000,000,000,000,000 or more, splicing variants and alternative splice events screened, independently or in combinations. In other embodiments, the screening of 10 or more splicing variants and/or splicing events is bundled with the comparison and ranking or sorting of each splicing variant or splicing event effect on cells by statistical methods. In various embodiments, the method provides for obtaining microarray expression level data. For example, the method may provide for applying a mathematical algorithm (such as a mathematical equation) to determine the isoforms expression for the target gene. It is understood by the skilled person that the present method would comprise the use of any suitable positive and/or negative controls, e.g. scrambled stAONs.

The present invention provides for a technology platform based on steric hindrance antisense oligonucleotide (stAON) technology for high-throughput bidirectional characterization of the therapeutic value of each differentially spliced event. Applications include drug target discovery, drug enhancer target discovery, synthetic lethal drug target discovery, and genome-wide functional genomic studies.

As such, advantageously, the present invention provides for a 2-way splice switching screening platform for characterising isoforms that are expressed between two or more states or groups of cells for a particular target gene. This platform allows for a new paradigm to discover new classes of drug targets, which are either unexplored or un-explorable with established screening platforms. The unique 2-way bidirectional screening approach lowers false-positives drug targets inherent in conventional one-directional knockdown screens, identifies targets with wide therapeutic index, as well as providing mechanistic insights on the targets identified.

In order that the present invention may be fully understood and readily put into practical effect, there shall now be described by way of non-limitative examples only preferred embodiments of the present invention, the description being with reference to the accompanying illustrative figures.

In the Figures:

FIG. 1a. Number of differential spliced events between two cell samples; FIG. 1b. Schematic illustration showing the use of AONs in a characterising splice-switching events in an embodiment of the present method.

Figure 2:
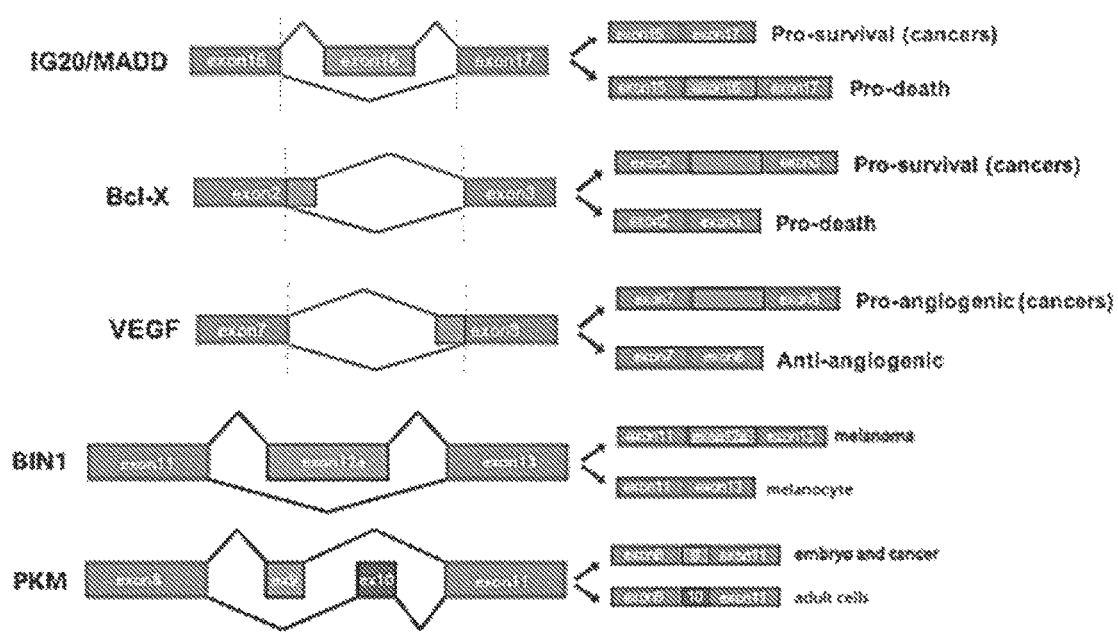
Figure 3:
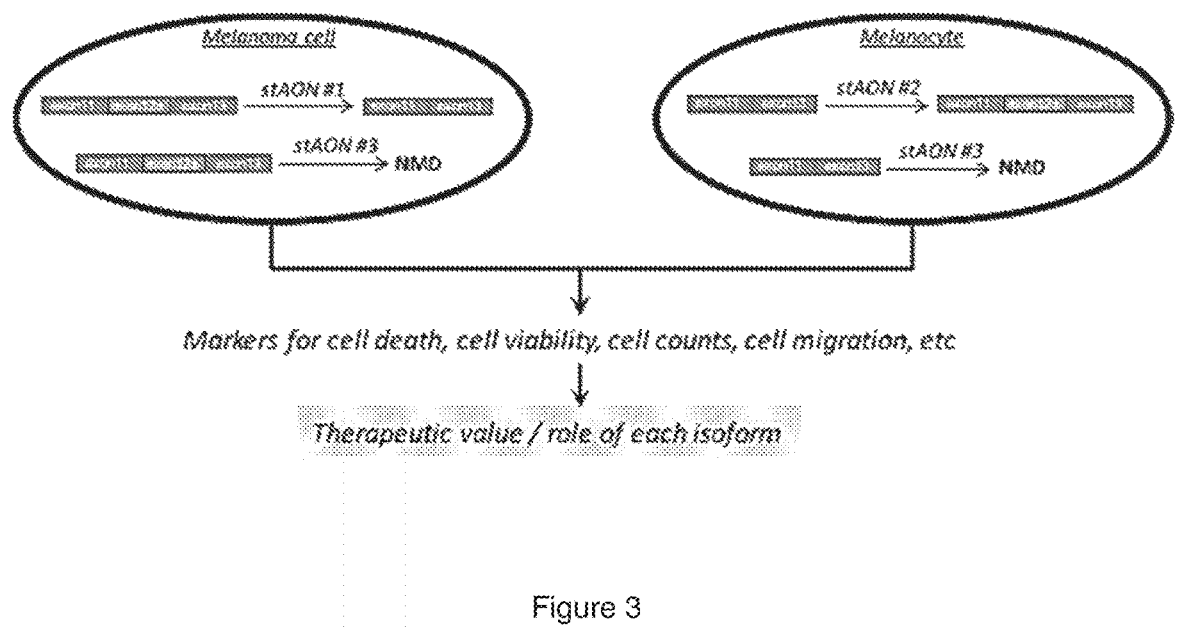
Figure 4:
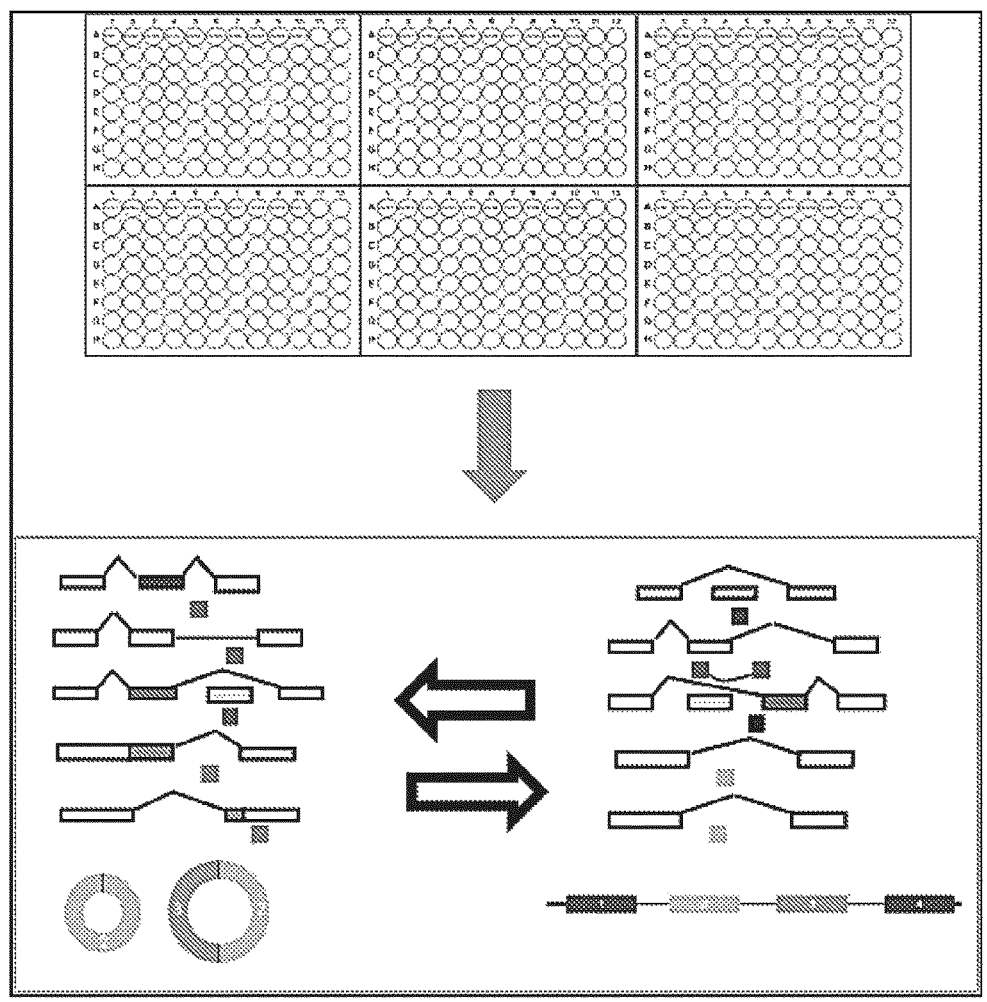
Figure 5:
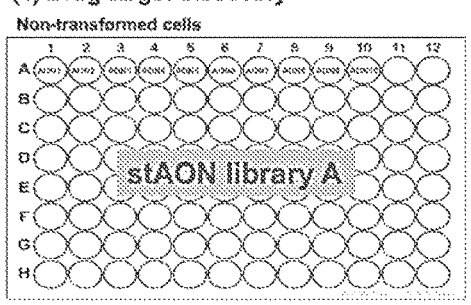
Figure 5:
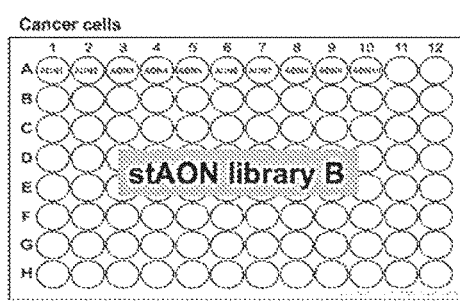
Figure 5:
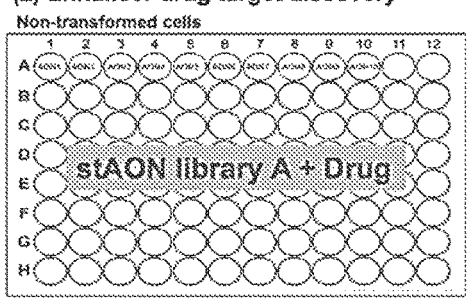
Figure 5:
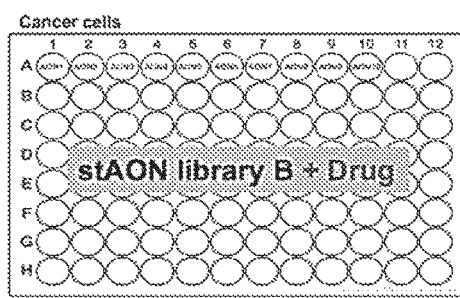
Figure 6:
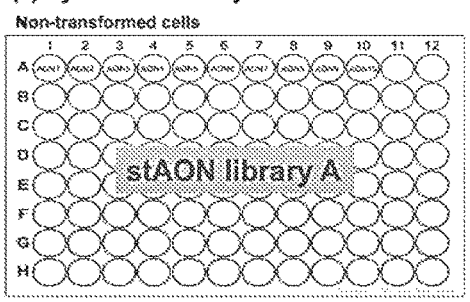
Figure 6:
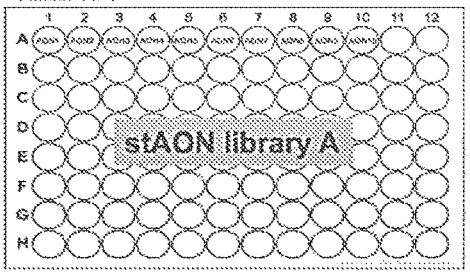
Figure 6:
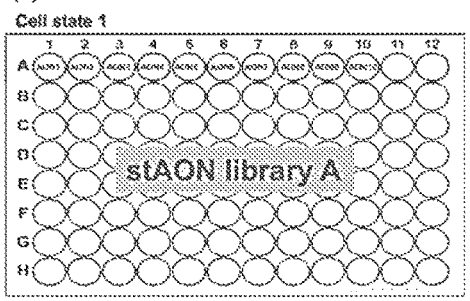
Figure 6:
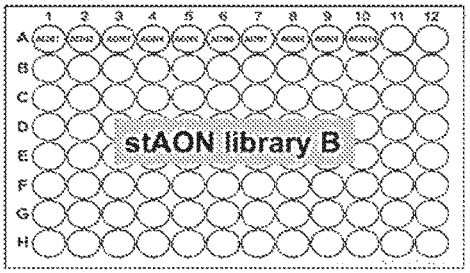
Figure 7:
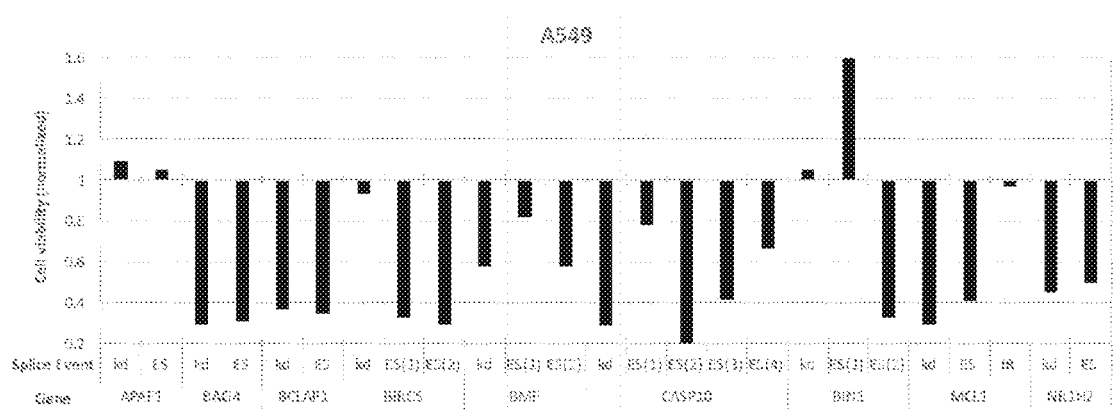
Figure 8:
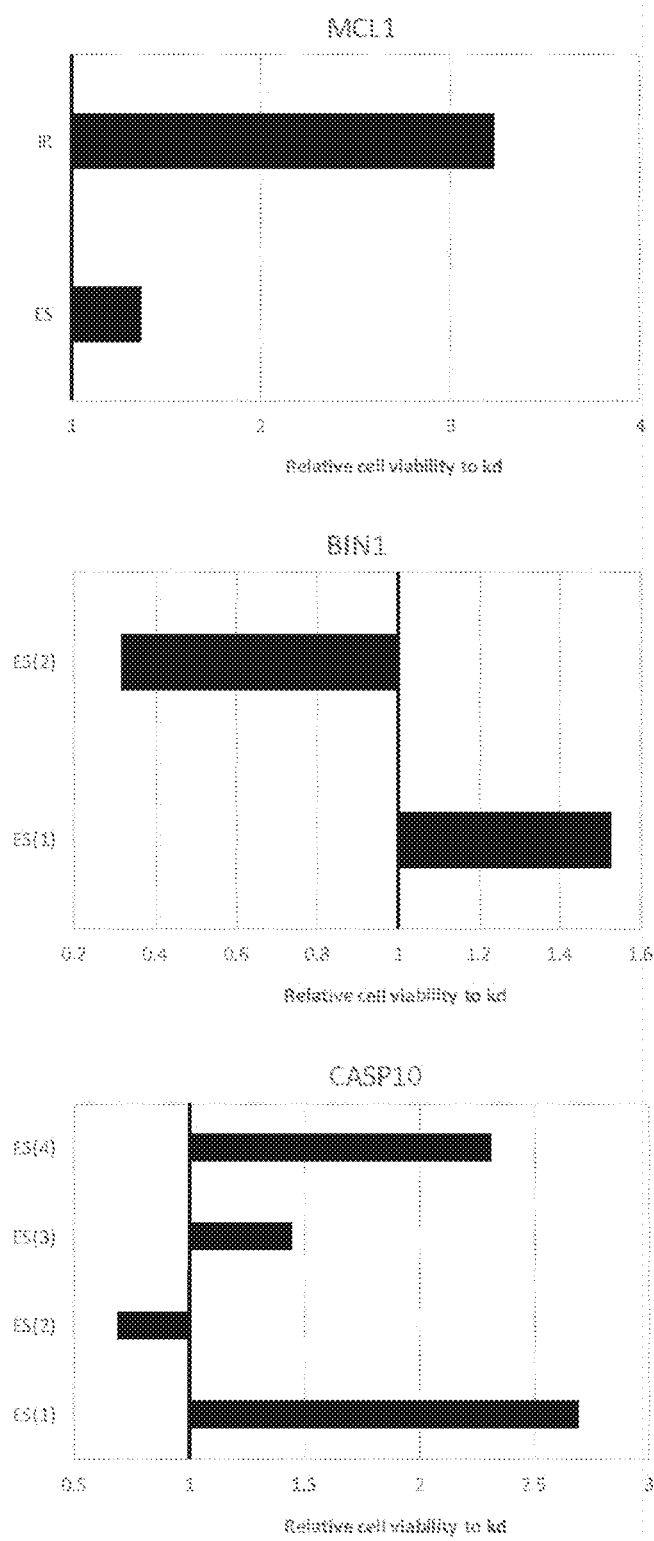
Figure 9:
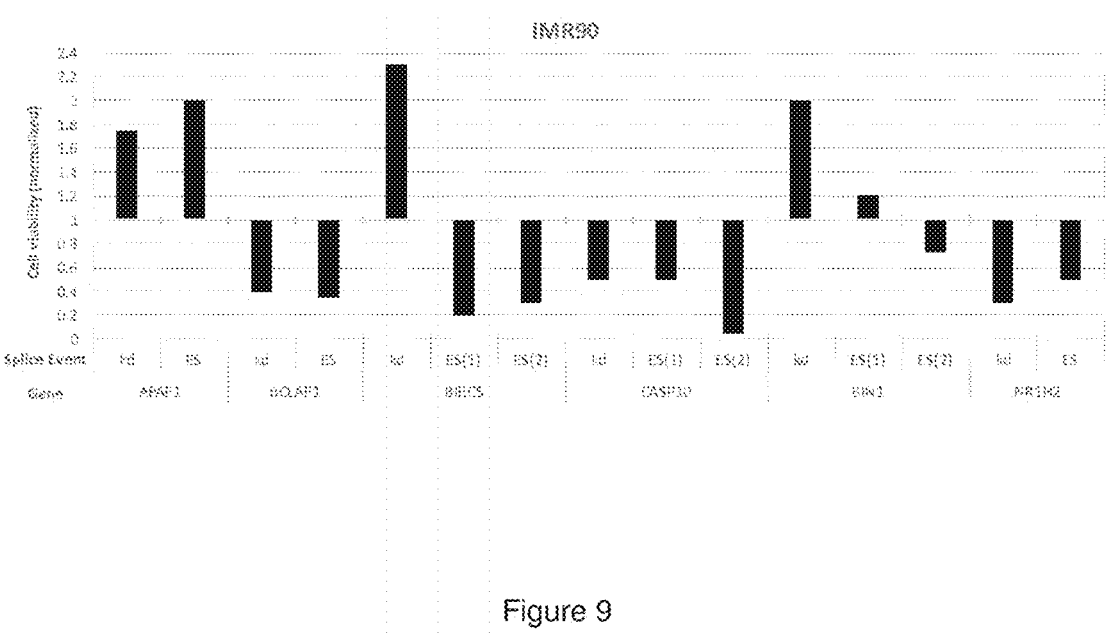
Figure 10:
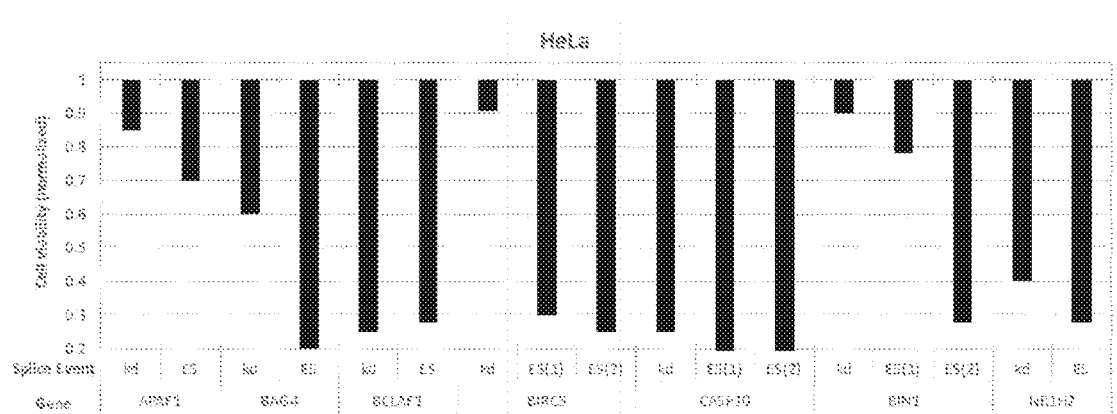
Figure 11:
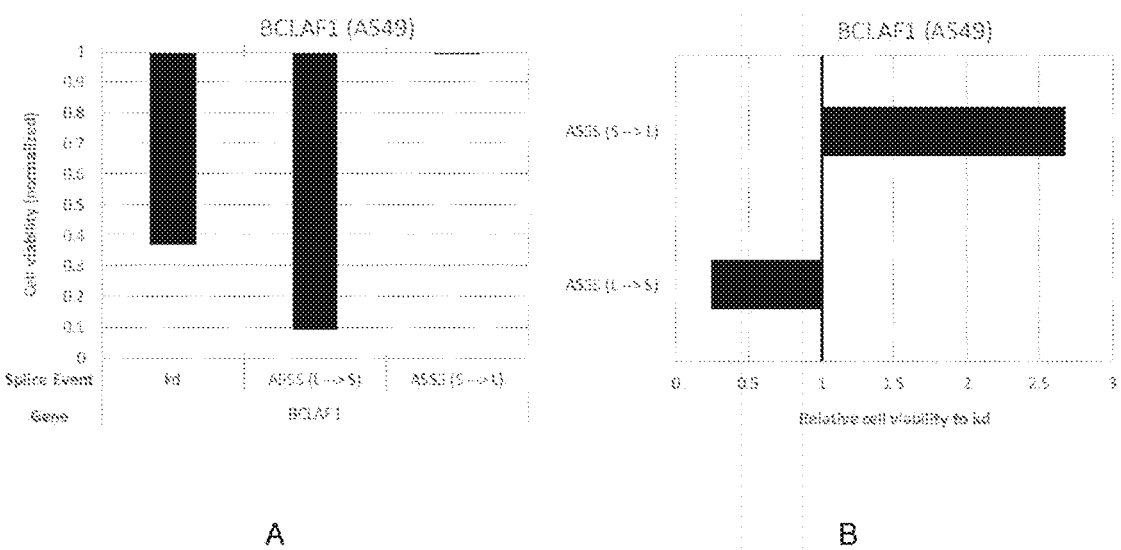

FIG. 2. Representative genes undergoing AS to express two isoforms that are highly relevant in human cancers;

FIG. 3. 2-way splice-switching screening;

FIG. 4. A 96-well stAON screening plate;

FIGS. 5 and 6. Schematic illustrations of phenotype-based cancer drug target screening;

FIG. 7. Shows results for A549 cell viability upon induction of splice-event switching and knockdown;

FIG. 8. Shows results for relative A549 cell viability (RCV) upon induction of splice-event switching in CASP10, BIN1 and MCL1;

FIG. 9. Shows results for IMR90 cell viability upon induction of splice-event switching and knockdown;

FIG. 10. Shows results for HeLa cell viability upon induction of splice-event switching and knockdown;

FIG. 11. Shows results for 2-way splice-event switching of BCLAF1 exon 5 in A549 cells. A5SS (L→S): switching the use of alternate 5' from the distal to proximal splice sites leading to the expression of the shorter target exon. A5SS (S→L): switching the use of alternate 5' from the proximal to distal splice sites leading to the expression of the longer target exon. Details of each modulated splice event are summarized in Table A1 (shown above).

Figure 12A:
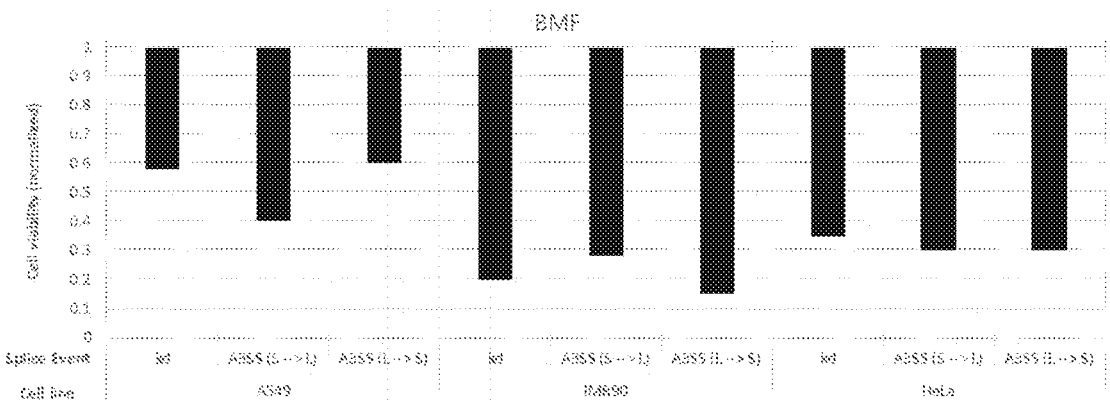
Figure 12B:
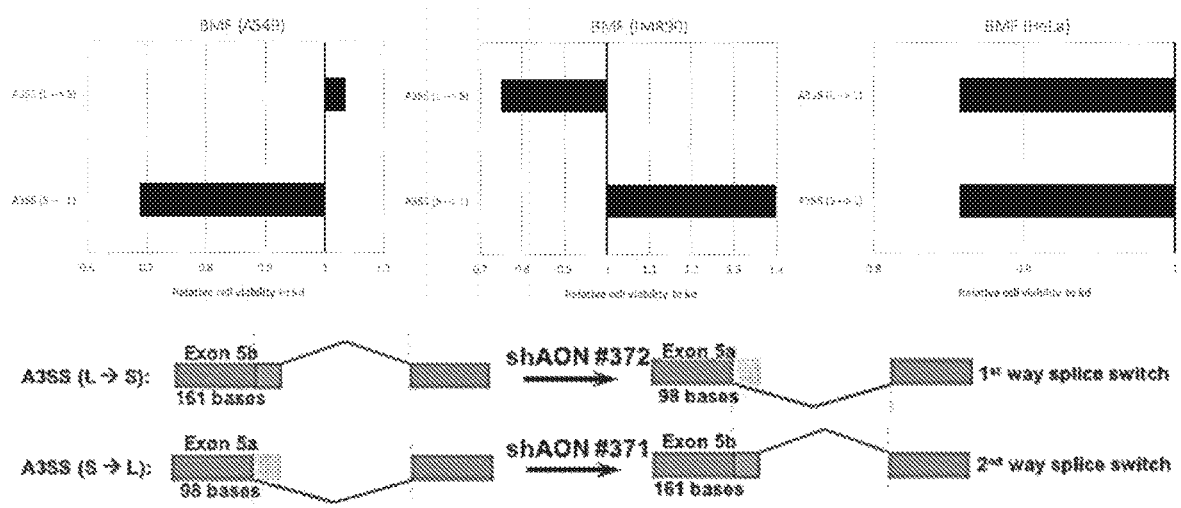
Figure 13A:
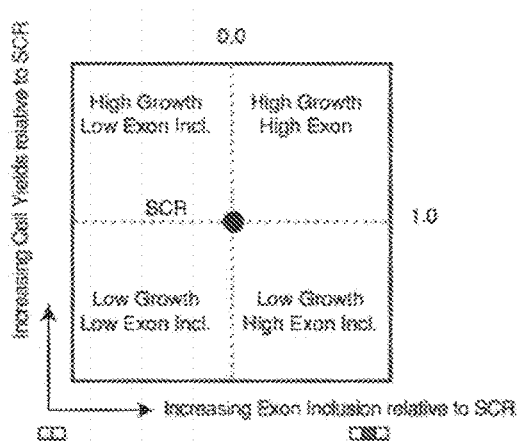
Figure 13B:
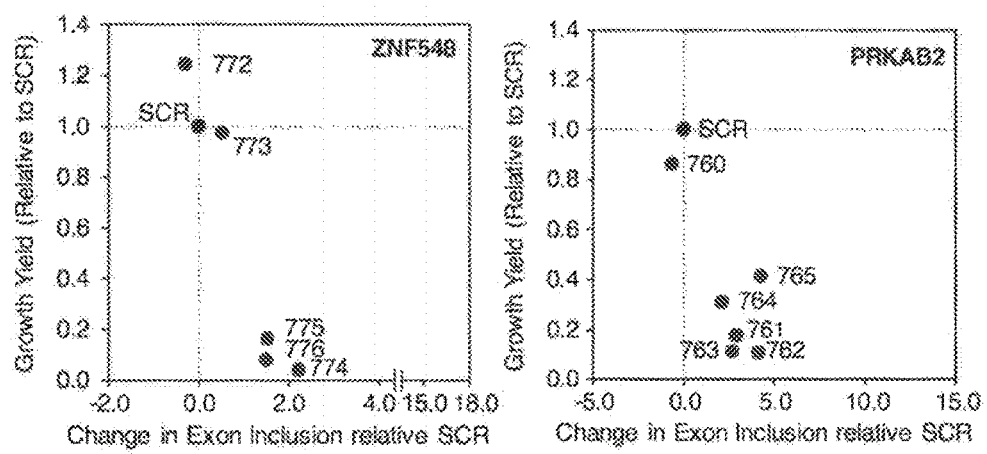

FIG. 11a: cell viability (vertical axis) is normalized by the cell viability observed when treated with a scrambled control stAON, NC2. The effect is inhibitory, none and proliferative when the cell viabilities (normalized) is less than 1, unity and greater than 1, respectively. FIG. 11b: RCV from a splice-event switch was obtained by normalizing its effect on viability with the corresponding effect when the target gene is knockdown;

FIG. 12. Shows results for 2-way splice-event switching of BMF exon 5 in A549, IMR90 and BMF cells. A3SS (L→S): switching the use of alternate 3' from the proximal to distal splice sites leading to the expression of the shorter target exon. A3SS (S→L): switching the use of alternate 3' from the distal to proximal splice sites leading to the expression of the longer target exon. Details of each modulated splice event are summarized in Table A1. FIG. 12a: cell viability (vertical axis) is normalized by the cell viability observed when treated with a scrambled control stAON, NC2. The effect is inhibitory, none and proliferative when the cell viabilities (normalized) is less than 1, unity and greater than 1, respectively. FIG. 12b: RCV from a splice-event switch was obtained by normalizing its effect on viability with the corresponding effect when the target gene is knockdown; and FIG. 13. Shows results for Mimicking HNRNPM-dependent linear splicing events in cells inhibits cell growth. FIG. 13a: schematic showing cell growth and exon exclusion/inclusion outcomes in stAON treated cells as compared to scrambled stAON treated cells. FIG. 13b: scatter plots of overall cell growth yields (y-axis) in relation to exon exclusion/inclusion levels (x-axis) upon treatment of the specified stAONs (given as numbers). Relative exon inclusion levels were measured and calculated based on target peak areas determined by FLA-PCR. Values are shown relative to cells treated with scrambled AONs. Labels (more details in Table 1A): SCR: Scrambled AON; 772-773: stAONs each inducing ZNF548 exon 3 exclusion; 773-776: stAONs each inducing ZNF548 exon 3 inclusion; 760: stAON inducing PRKAB2 exon 8 exclusion; 761-765: stAONs each inducing PRKAB2 exon 8 inclusion.

DEFINITIONS

The present invention will be described with respect to particular embodiments and with reference to certain drawings, but the invention is not limited thereto but only by the claims.

Any reference signs in the claims shall not be construed as limiting the scope. The drawings described are only schematic and are non-limiting. In the drawings, the size of some of the elements may be exaggerated and not drawn on scale for illustrative purposes. Where the term "comprising" is used in the present description and claims, it does not exclude other elements or steps. Where an indefinite or definite article is used when referring to a singular noun e.g. "a" or "an", "the", this includes a plural of that noun unless something else is specifically stated. Furthermore, the terms first, second, third and the like in the description and in the claims, are used for distinguishing between similar elements and not necessarily for describing a sequential or chronological order. It is to be understood that the terms so used are interchangeable under appropriate circumstances and that the embodiments of the invention described herein are capable of operation in other sequences than described or illustrated herein.

The following terms or definitions are provided solely to aid in the understanding of the invention. Unless specifically defined herein, all terms used herein have the same meaning as they would to one skilled in the art of the present invention. Practitioners are particularly directed to Sambrook et al., Molecular Cloning: A Laboratory Manual, 2nd ed., Cold Spring Harbor Press, Plainsview, N.Y. (1989); and Ausubel et al., Current Protocols in Molecular Biology (Supplement 47), John Wiley & Sons, New York (1999), for definitions and terms of the art.

The definitions provided herein should not be construed to have a scope less than understood by a person of ordinary skill in the art.

The present invention provides for a 2-way splice-switching screen platform which enables the high-throughput bidirectional characterization of the therapeutic value and biological role of each differentially spliced event. To explain the 2-way splice-switching screen, consider as an example the BIN1 gene whose exon 12A is retained in melanoma cells, but is excluded in melanocytes (FIG. 2). As illustrated in FIG. 3, stAON #1 (steric hindrance antisense oligonucleotide) is designed to induce the exclusion of BIN1 exon 12A in melanoma cells and "switch" BIN1 expression to the normal isoform, thus reversing the splice event associated with oncogenesis. stAON #2, on the other hand, switches BIN1 expression to the cancer isoform in melanocytes. stAON #3 will suppress BIN1 expression by inducing nonsense-mediated decay (NMD) in both cells (done in a separate experiment). Subsequently, the therapeutic value of the splicing of BIN1 exon 12A is correlated with the normalized magnitude changes in the specific cell marker(s) observed at each direction of screening; the magnitude changes are normalized with the changes observed when BIN1 expression is suppressed.

As will be described in detail later, the general steps of characterising and screening the splicing variants and/or events (identifying which isoforms to screen) according to an embodiment of the present invention is as follows:

1. Characterisation of Splice-Events to Screen.
   This can be broken down into the following steps:
   a. Perform RNA-sequencing on at least two RNA samples extracted from cells at different state/phenotype, physiological conditions, treatment plans, or/and etc. Deep paired-end RNA-sequencing or single-molecule sequencing platforms with very long reads (at least 20,000 bases per read) is preferred.
  b. Perform bioinformatics analyses on the raw reads from the RNA-sequencing to obtain splice-events that occurred in all samples, differential splice-events (i.e. that occurred in only one of the samples), and splice-events that do not occurred in both samples. Such bioinformatics analyses include mapping raw reads to the reference genome using open-sourced or commercially available alignment software packages e.g. Tophat (tophat.cbcb.umd.edu/), STAR (github.com/alexdobin/STAR), and etc. Aligned reads were then quantified for expression using for e.g. Cufflinks (cufflinks.cbcb.umd.edu/) and edgeR (www.bioconductor.org/packages/release/bioc/html/edgeR.html). Genes were considered to be significantly differentially expressed at P<0.05 and abs(log 2[FPKM])ratio>1; FPKM=Fragments Per Kilobase of transcript per Million mapped reads. To determine differential splicing events, rMATS rnaseq-mats.sourceforge.net/) was used to count junction reads and reads falling into the tested region within ENSEMBL gene definitions. Splicing events were labelled significant if the sum of the reads supporting a specific event exceeded ten reads, and P<0.05. Note: the P value criteria can be altered depending on the stringent requirements; lower P value corresponds to stricter criteria.
  c. (Optional step) Validate the splice-events that are obtained in the previous step experimentally. This can be done by using conventional PCR and Sanger sequencing.
  d. (Optional step) Narrowing down the list of splice-events to screen. This can be done from literature surveys, gene ontology data, protein domain data, and etc. This step is necessary when there are tens of thousands of splice-events to screen or depending on the research budget.
2. Design, Synthesize and Validate the Following Three Screening Libraries.
  a. stAONs to induce splice-events to screen.
  b. stAONs to reverse the splice-events to screen.
  c. To knockdown or knockout the target genes. The type of reagents to achieve this step is up to the lab's preferences. For knockdown, we can design stAON to induce nonsense-mediated decay, or design gapmers to induce RNaseH degradation, or design siRNA/shRNA to induce RNAi. For gene knockout, CRISPR-based guide RNAs (gRNAs) will be designed.
3. Performing the Screens.
  a. Each splice-event switching stAON will be placed in a multi-well plate (e.g. 96-wells or 384-wells) at a final concentration of 100 nM. Depending on the cells in study, the stAON will either be transported into the cells either via reagents (such as liposome-based or polymer-based transfections) or electroporation.
  b. Each reagent to for knockout or knockdown the target gene will be placed in each well. The final concentrations and transportation protocols will depend on the reagent used. For NMD-inducing stAONs and gapmers, the conditions are similar to above.
  c. Cells will be placed in all the wells. Note:
    i. Depending on the screening design, step 3(a), 3(b) and 3(c) can be ordered in any combinations.
    ii. Depending on the screening design, additional treatment can be added to the cells. For instance, a drug can be added to screen for splice-events that will confer resistance to it or to enhance the drug's efficacy.
    iii. In each plate, there must be at least a well for scrambled stAON and a well for untreated. d. Repeat the above steps for duplicates or triplicates. Each screen will be repeated for Triplicates.
4. Readouts.
  The type of cellular and/or molecular readouts (and thus the experimental protocols and equipment to use) depends on the aim of the screens. Representative examples are cell viability, cell cycle staging, cell death, cell proliferation, cell migration, cell morphology, cell differentiation state, and etc.
5. Data Analysis to Identify the Specific Splice-Events that have Value to the Screening Aim(s).
  The definition of normalized cell viability and relative cell viability (RCV), given in this document, can easily be generalized to other types of readout for use as parameters.

EXAMPLES

We set out below specific examples of the present invention.
Methods and Materials
  Synthesis of stAONs and gapmers. stAONs are synthesized as single-stranded 2'-O-methyl modified RNA bases linked by a phosphorothioate backbone (Sigma-Aldrich, SG and IDT, SG). Gapmers are synthesized as single-stranded DNA bases each flanked by three 2'-O-methyl modified RNA bases linked by a phosphorothioate backbone (Sigma-Aldrich, SG and IDT, SG).
  Cell transfection with stAONs. Cells were seeded in 6-well plates at $1.0\text{-}1.5\times10^5$ cells per well in 1 ml transfection medium, and were incubated for overnight. Cells reached around 40% confluence and the culture medium was reduced to 900 µl before transfection. 10× Transfection mixture with a fixed ratio of 1:2 of stAON (in 100 pmol): lipofectamin 2000 (in µL) at various concentration was prepared in Opti-MEM medium (Invitrogen Singapore Pte Ltd, Singapore) to a total volume of 100 µl, incubated for 20 minutes at room temperature, and added into the cell culture.
  Cell viability assay. Measurement of cell viability and proliferation was performed in 96 well plate ($3.5\times10^3$ cells in 100 µl medium per well) using the Thiazolyl Blue Tetrazolium Bromide (MTT) assay or CellTiter-Blue cell viability assay (Promega, Singapore). Cells were transfected in the 96 well plate with a mixture of stAON and lipofectamin 2000. For MTT assay (used for adherent cells), medium was replaced by DMEM media (100 µL/well) with MTT (0.5 mg/ml) and incubated for 4 hours at 37° C., and then changed to 100 µl of isopropanol. Absorbance was measured using a microplate reader (Molecular Devices, Sunnyvale, Calif., USA) at a wavelength of 570 nm with background subtraction at 630 nm, and converted to the number of live cells using a calibration curve for absorbance against live cell number. For CellTiter-Blue cell viability assay (for suspension cells), Cell-Titer Blue reagent was added (11 µL/well) and incubated for 4 hours at 37° C. Fluorescence was measured using the microplate reader with an excitation of 570 nm and an emission of 600 nm.
  FIG. 4 shows a 96-well stAON screening plate template. With the exception of experimental controls, each well consist of one or more stAONs to induce one specific splice event. Depending on the number of splicing events to be switched and therefore the number of stAONs required in the screen, one or more 96-, 192- or 384-wells format plates may be used. The design of each screening plate is described as follows:
1. Each well is filled with 10 picomoles of stAON in 0.1 ml of medium for a single transfection dose at 100 nM.
2. Each stAON is either single- or dual-targeting.
3. In a given plate, four wells are reserved for negative controls namely, water, transfection reagent only, scrambled stAON #1 and scrambled stAON #2.
4. More than one distinct stAONs can be used to induce a specific splice switching. They are either filled together in a well or in separate wells.
5. For combinatorial switching of multiple splice events, each of the respective stAONs is filled in a well either in tandem or successively.
6. Replication experiments can be performed either by plate or by wells, or both.

Upon incubation of cells with the stAONs, the resultant cell phenotype is characterized by the magnitude changes in the specific cell marker(s) observed at each direction of screening, normalized with the magnitude change as observed when the target gene expression is suppressed. Depending on the desired cell phenotype in study, the respective cell processing assay/protocol will be performed. Examples include cell viability, cell proliferation, cell death, cell cycle, cell migration, and etc. so long as the specific cell marker(s) can be measured. The readout from each well will be internally normalized with the negative controls' wells and compared among the two direction of screening results. Because the resultant correlation strength of a splicing event is calculated from the bidirectional screening results, the therapeutic value of a splicing event, which changes a cell marker in opposite ways when switched back-and-forth, is higher than one that only effects a single-directional change.

The following mathematical algorithm is used for characterising the phenotypes of the cells:

$r_{i,j,s}$: (logarithmic or linear scale) normalized readout upon switching isoform i to isoform j using stAON s; $r_{i,j,s}=0 \, \forall i=j$; normalization is with the magnitude change of the readout when the target gene expression is suppressed.

$\Delta r_{ij} = r_{i,j,s1} - r_{i,j,s2}$; if $\Delta r_{ij} \neq 0$ and $\text{sgn}(r_{i,j,s1}) \neq \text{sgn}(r_{j,i,s2})$, isoforms i and j have opposite effects on the specific cell phenotype readout; if $\Delta r_{ij} \neq 0$ and $\text{sgn}(r_{i,j,s1}) = \text{sgn}(r_{j,i,s2})$, isoforms i and j have differential effects on the specific cell phenotype readout; if $\Delta r_{ij} = 0$, isoforms i and j have either no or no differential effect on the specific cell phenotype readout.

This facilitates the objective comparison of the effect from switching each splice variant or event.

As mentioned earlier, the method of the present invention is useful in drug screening methods. FIGS. 5 and 6 are schematic illustrations of phenotype-based cancer drug target screening for classic drug target screens and synthetic lethal drug target screen that may be used with the present invention's method. These plate templates shown in the Figures provide an example of how the present method may be scaled up to be a high-throughput method for screening using the characterisation algorithm.

With reference to the FIGS. 5 and 6, (1) classical drug target screen to identify isoforms or splice events that have therapeutic values. stAONs in library A are designed to switch splice events that are observed in non-transformed cells to splice events that are observed in the corresponding cancer cells. stAONs in library B are designed to switch splice events that are observed in cancer cells to splice events that are observed in the corresponding non-transformed cells. (2) Enhancer drug target screen to identify isoforms or splice events that exhibit sensitivity or augment the response to a specific drug. The sensitivity to a stAONs in libraries A and B are identical to those in (1). (3) Synthetic lethal drug target screen to identify isoforms or splice events that have therapeutic values. Only a single stAON library A is used. The stAONs are designed to switch splice events that are both observed in non-transformed and cancer cells to other endogenous or alternate splice events. (4) This is similar to (1) above. The difference is the aim of the screen is to identify isoforms or splice events that play critical biological roles that transforms cell state 1 to cell state 2, and vice versa.

In the following examples, it is shown how 1-way and 2-way splice-switching screenings of the present invention are carried out.

1-Way Splice-Switching Screening

Distinct Cell Phenotypes Upon Modulation of Specific Splice-Events

An unbiased splice-event switching screen wherein specific events are induced via steric hindrance antisense oligonucleotides (stAONs) was performed to investigate the effect on cell viability. 20 splice-events occurring in 9 target genes were screened on A549, IMR90 and HeLa cells; A549 are adenocarcinomic human alveolar basal epithelial cells used as models for NSCLC (non-small cell lung cancer), IMR90 are normal human foetal lung fibroblast, and HeLa are cervical cancer cells.

For each splice-event, its effect on cell viability was compared with the knockdown of the respective target gene, which was achieved by either nonsense-mediated decay (NMD) induced via stAONs or RNaseH degradation induced via gapmers. A total of 20 splice-event switching stAONs, 7 NMD-inducing stAONs, and 2 gapmers were designed by our proprietary stAON design platform, all of which are novel molecules. Two experimental readouts are of particular relevance—the directional influence on cell viability (i.e. inhibitory or proliferative) and the magnitude of change in cell viability.

FIG. 7 depicts the disparate A549 cell viability from the splice-event switching screen. Cell viability (vertical axis) is normalized by the cell viability observed when treated with a scrambled control stAON, NC2. The effect is inhibitory, none and proliferative when the cell viabilities (normalized) is less than 1, unity and greater than 1, respectively. Legend: kd—knockdown, ES—exon skipping event, IR—intron retention event. Details of each modulated splice event are summarized in Table A1. The results and discussion are summarized as follows:

APAF1: both knockdown (kd) and exon skipping (ES) splice event resulted in cell proliferation of similar magnitude.

BIRC5: each of the two ES splice events resulted in substantially more inhibitory effect on cell viability than knockdown.

BMF and CASP10: differential inhibitory effects on cell viability were observed among different ES splice events of a target gene.

BIN1: the two ES splice events resulted in opposing effect on cell viability—ES(1) is proliferative whereas ES(2) is inhibitory.

MCL1: the IR (intron retention) splice event did not affect cell viability significantly as compared to the large inhibitory effect by the knockdown and ES splice event.

BAG4, BCLAF1 and NR1H2: both the knockdown and the ES splice events resulted in similar inhibitory effect.

To further appreciate the differential effect on A549 cell viabilities, the relative cell viabilities (RCVs) from splice-event switch for CASP10, BIN1 and MCL1 were computed (FIG. 8). In the present invention, RCVs is the same as "therapeutic value" described above that is inferred from the effect on cell viability. Specifically, the RCV compares the magnitude of a splice-event switch on cell viability with the corresponding magnitude when the target gene is knockdown; as such, it cannot discern the absolute directionality of the effect on cell viability from a splice-event switch. The biological interpretation of RCV is described below:

RCV>1. The effect on cell viability from a splice-event switch is relatively proliferative than the knockdown of the target gene, and the relative proliferative effect increases with RCV. Note: the normalized cell viability effect from a splice-event switch and target gene knockdown need not be both proliferative in this case; in fact, the possible combinations of (splice-event switch, target gene knockdown) normalized cell viability effect are (proliferative, proliferative), (proliferative, inhibitory), (inhibitory, inhibitory) but not (inhibitory, proliferative).

RCV<1. The effect on cell viability from a splice-event switch is relatively inhibitory than the knockdown of the target gene, and the relative inhibitory effect increases as RCV decreases. Note: the normalized cell viability effect from a splice-event switch and target gene knockdown need not be both inhibitory in this case; in fact, the possible combinations of (splice-event switch, target gene knockdown) normalized cell viability effect are (proliferative, proliferative), (inhibitory, proliferative), (inhibitory, inhibitory) but not (proliferative, inhibitory).

RCV=1. There is no difference in the effect on cell viability from a splice-event switch and the knockdown of the target gene.

As depicted in FIG. 8, different type of splice-events (ES and IR in MCL1) and the skipping of different exons (in BIN1 and CASP10) all resulted in distinct effects on the relative cell viability. In addition, the effects can be opposing; ES(2) versus ES(1) in BIN1, and ES(2) versus the rest in CASP10. Once again, with reference to FIG. 8, RCV from a splice-event switch was obtained by normalizing its effect on viability with the corresponding effect when the target gene is knockdown, and details of each modulated splice event are summarized in Table A1.

Next, a subset of the screen was applied on IMR90 cells. FIG. 9 (legends the same as FIG. 7) depicts the disparate IMR90 cell viability from the splice-event switching screen. As IMR90 cells are non-tumorigenic, it will be interesting to compare and identify differences in the screening results with the tumor A549 cells, both of which originate in the lungs. The notable differences are summarized below:

APAF1: IMR90 cells are almost twice as proliferative as compared to A549 cells from both kd and ES splice event.

BIRC5: each of the two ES splice events resulted in similar inhibitory effect on both IMR90 and A549 cell viabilities. However, as kd in IMR90 is proliferative but is inhibitory in A549, the directional effects of ES(1) and ES(2) on cell viability are opposing in IMR90 cells.

CASP10: differential inhibitory effects on cell viability were observed among different ES splice events of a target gene.

BIN1: while the directional effects of ES(1), ES(2) and kd on cell viability are identical in both IMR90 and A549 cells, their magnitudes are distinct. As such, the RCVs of ES(1) and ES(2) differ considerably in both cell lines.

BCLAF1, CASP10, NR1H2: similar to A549.

Notably, the differences in viability between IMR90 and A549 cells from the switching of particular splice-events may contribute to a wider therapeutic window through which tumour cells can be selectively eliminated. Thus, splice-switching screens have the ability and advantage to identify splice-event as therapeutic targets for drug discovery and development that may lead to more efficacious drugs with a higher therapeutic index.

Similarly, a subset of the screen was applied on HeLa cells. FIG. 10 (legends the same as FIG. 7) depicts the disparate HeLa cell viability from the splice-event switching screen. By contrast to A549 and IMR90 cells, the effect on HeLa cell viability from splice-event switching are all inhibitory. For splice-events that resulted in inhibitory effect on both HeLa and A549 cell viabilities, the magnitudes are similar.

In conclusion, we observed both directionalities and a broad range in the magnitude of effects on cell viability, as compared to gene knockdown, among different cell lines, and different types of splice-event switching, target exons in ES and target genes.

2-Way Splice-Switching Screening

The 2-way splice-event switching screen was implemented by designing an stAON to induce a specific splice-event, and another stAON to reverse the splice-event switch. In the first example, we switched the use of alternate 5' splice sites of BCLAF1 exon 5 in A549 cells (Table 1A). FIGS. 11a and b11 depicts the effect on A549 cell viability upon knockdown (kd) of BCLAF1, switching to the use of the proximal 5' splice site to expresses the short exon 5 (A5SS(L→S)), switching to the use of the distal 5' splice site to expresses the long exon 5 (A5SS(S→L)). The respective RCVs indicate that the relative cell viability from the A5SS(S→L) switch is opposite to from the A5SS(L→S) switch—proliferative in the former and inhibitory when reversed in the latter.

In the second example for the 2-way screen, we switched the use of alternate 3' splice sites of BMF exon 5 in A549, IMR90 and HeLa cells (Table 1A). FIG. 12 depicts the effect on the cell viability upon knockdown (kd) of BMF, switching to the use of the proximal 3' splice site to expresses the long exon 5 (A3SS(S→L)), switching to the use of the distal 3' splice site to expresses the short exon 5 (A3SS(L→S)).

While the effect on viabilities are all inhibitory in each of the cell lines, the RCVs reveal an interesting observation. In A549 cells, the relative cell viability from the A3SS(L→S) switch is opposite to from the A3SS(S→L) switch—inhibitory in the former and proliferative when reversed in the latter. Although this opposing effect is also observed In IMR90 cells, the inhibitory to proliferative effect however is interchanged (proliferative to inhibitory instead). Given that both A549 and IMR90 cells originate from the lung, with the former being tumor cells and latter being non-tumorigenic, the interchanged effect observed from the 2-way splice-event switching suggests that the expression switch of the BMF exon 5 from the short to the long version may have therapeutic value.

Therefore, a 2-way screen has the highly-valued advantage of providing a mechanistic information on the drug targets identified.

As the third example, we induced the inclusion and exclusion of ZNF548 exon 3, PRKAB2 exon 8, KAT6A exon 2, EED exon 10, ZNF304 exon 2, and KRBOX4 exon 6 in LNCAP prostate cancer cell line (Table 1A). FIG. 13 shows the effect on cell viability for ZNF548 exon 3 and PRKAB2 exon 8; no phenotype change was observed for the rest of the screen. In both of the genes, the inclusion of the respective exons leads to loss of cell viability whereas cell viability is maintained when the reverse (exon exclusion) is induced.

DISCUSSION

The method of the present invention described modulates specific splicing of a gene to screen for isoforms or splice variants expressed from the gene. Therefore, it may also be said that a more precise term over "target gene" is "target gene isoform" or "target gene splice variant".

One-directional high-throughput functional screens for isoforms and alternative splice events is novel and non-obvious. The most valuable benefit of parallellization in a screen, besides substantial productivity gain, is to make possible the comparison and therefore sorting or classification of samples (isoforms or splice events) by their effect on the desired cell physiology or biological phenomenon, which are observed/measured under the same experimental condition with similar systematic errors. Because statistical measures (e.g. P-value, FDR and the like) is essential to discern differences between samples is actual and not likely to be by chance, a non-trivial effort, this imposes a requirement of at least 10 independent samples in a screen. Another condition is the normalization of the biological readout from splice event switching with the readout from the target gene expression suppression. Another condition is the normalization of the biological readout from splice event switching with the readout from the target gene expression suppression.

It should be noted that the present invention is inventive for the following reasons:
A. Modulating a single alternative splice event or an isoform should not be considered as a screen.
B. Not straightforward to extend a single sample experiment, to 10 or more samples to be qualified as a screening experiment.
C. Simultaneous modulations per sample, wherein more than one isoforms and/or alternative splice events encoded from one or more target genes are simultaneously modulated by multiple steric hindrance antisense oligonucleotides in a sample, to screen for synergistic effects.

The present invention also provides for a 2-way splice-switching screening platform is a new paradigm to discover new classes of drug targets, which are either unexplored or un-explorable with established screening platforms; the latter screens for ~20,000 human genes rather than ~100,000 human splice events or variants. Bidirectional target discovery approach lowers false-positives inherent in conventional one-directional knockdown screens. Bidirectional screen is not merely two one-directional screens. The capability and therefore value of bidirectional over one-directional screening is the ability to identify isoforms and/or alternative splice events as candidate drug targets that have mechanistic basis, which is a requirement by FDA for new drugs, and wide therapeutic windows. To realize the advantages, a bidirectional screen is designed as such:
 1. The simplest bidirectional screen, for example applied with only two cell states (e.g. healthy and diseased), will require four screens. (Number of screens=2*number of cell-states)
  a. Splice-switching screen on cell-state 1.
  b. Knockdown/knockout screen on cell-state 1.
  c. Splice-switching screen on cell-state 2.
  d. Knockdown/knockout screen on cell-state 2.
 2. Horizontal analyses: the therapeutic value of a corresponding bidirectional pair of sample is the net effect on cell physiolology or biological phenomenon defined, linearly, as (1a-1b)-(1c-1d) for simplicity, which will be subjected to statistical analyses; it can be formulated non-linearly.
 3. Vertical analyses: the comparison and therefore sorting or classification of bidirectional sample pairs for their therapeutic values, after the horizontal analyses.
 4. Both the horizontal and vertical comparisons will quickly become complicated with number of cell-states investigated. In a typical drug target screening or discovery project, it is common to screen more than 10 cell states.

The method also addresses key limitations in established platforms for target discovery, and drug discovery and development, and may be useful in the following applications:
 1. Drug target discovery. 2-way characterization of therapeutic value of differential splice events.
 2. Drug enhancer target discovery. 2-way characterization of therapeutic synergy and index of differential splice events. Here, cells in each well will be incubated with a stAON and the drug. Four additional negative control wells will be used for—drug only, drug+transfection reagent only, drug+scrambled stAON #1, and drug+scrambled stAON #2.
 3. Synthetic lethal drug target discovery. 2-way characterization of synthetic lethality effects of non-differential splice events. Here, stAONs are used to switch an isoform that are both observed in the two cell states to one or more of its alternative isoform(s).
 4. Functional genomic studies. 2-way characterization of biological functions of differential splice events.

Existing methods of drug candidate screening, for example the knockdown methodology employed in target discovery screening platform, cannot discriminate among alternatively/aberrantly spliced linear/circular isoforms expressed from a gene; as such, all isoforms are knockdown simultaneously. Thus, isoforms as drug targets are not and cannot be screened with conventional platforms. This is a big limitation given that splicing regulation plays a critical role in normal physiology, and alternative and/or aberrant splicing events are prevalent in human diseases.

Also, the four main classes of therapeutics (chemical inhibitors, monoclonal antibodies, gapmers and peptides) are generally applicable for target suppression only. This critically limits the range of therapeutic strategies and modalities.

The present invention targets a wide therapeutic index. A splice-switching stAON, whose mechanistic action switches the expression of its target from the disease to its normal form, achieves two therapeutic effects in tandem—knocking down the diseased form and restoring expression of the normal form. This therapeutic strategy could produce synergistic therapeutic outcome and/or confer a wide therapeutic index over conventional therapeutic inhibitors.

In addition to the above, the present invention also describes the use of antisense as reagents to change the expression of gene isoforms and alternative splice events, for the purpose to characterise their therapeutic values and/or biological functions. It is envisaged that discovery of novel targets will empower and enable next-generation therapeutic strategies and modalities. Therefore, the systematic and rational approach significantly reduces target discovery and drug development time and resource, and therefore lowers investment risk.

Whilst there has been described in the foregoing description preferred embodiments of the present invention, it will be understood by those skilled in the technology concerned that many variations or modifications in details of design or construction may be made without departing from the present invention.

SEQUENCE LISTING (127 sequences)

SEQ ID NO: 1 - DNA, 90293 bp, Homo sapiens
acttctacgcgcgcgggcatgagccgtggcaggagtgcgcggcggcagcggtggccgccccttggggcttggggtgtgtttatttgcataagcgggcgcgcgccgtccgggctgggtggatccggcgggatttgactgctccgctgtccagaggcggagaagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttgggtaagttgacctcctcgcttttctccccgagccaggttctttggaggcttggtagctgatttcagggactgagaatttgaggacatggaatatttgataaccatcctgctcctgtaccaggaagagaaattctgtaatgaggaagtagtaaacttggggttttcgtggataaacgtgcgctgttttctgttttacgtccatgaagagttttggctttccattttgttgtgggttacaaaaggttttgagacttagttcagataagttgtgcagttttaaaacgtatttaagatttgcatattttagtttaacaggactaggtgaaattggaaattagtttcagaaaaccagagtgtcttatttgcttagctattggacatcacctaaaaaattcattcattcttgttttttcacatcgaatttcattactataaattaaggaacattttatgtttaagaggacaaaaacgttattaacattttaaaaaatgagagttttgattcgaatcaataactttttatcagttttgtgcccctgctgggcattttgtaagccttgacaagcataggcaaatgccctacgtccgtccctgtttttccaagtgctacatttggtgacttcaaaaacagtcattgaagcttgataattattgcccccttctgtgagctccaagttacttgtgctctgtttttgcacttcgggcattcacattcccactctctctctctttttcttctttgagtagactgtgaattatttcaggcaaatgactcaatcttttctgtagtcttggtgtctgacatatagggaggggcacaaatgtgtattgaatgaatgaattgataaacccgtttagactctttcactctatacattgtgtaaagttctgttaatgttttgaaaacttgcagatattgtgaactgggttttatgcccatggaaaaatttgcattatatttgaaataaagttgctagaaacgtcaagtattttactataaaggctgttattctttcctcatgtcctcctggtctgagaaatcacatcagaaagtgtttcctgttgctttgtgggaaatgtgtttagcaaggaggacctagagctgacatcctccttgaacgagaactaatactcaatagtaacaatgctctattcactcttatgtttgataaggaaaacaagaagtctcttaatattaggacttcaatgtaatcactattttatacaatcttaattaaaaaaggaagtattttattgtaagaaatgataatgtgtgctaaaaaaaattgacagtagaggccgggcatggtggggctcacaagtgtaatcccagcactttcggaggctgtggcgggtggatcacctgaggtcaggaattcaagaccagcctggtcaacatggtgaaaccccgtctgtactaaaaaaaaaaaaaaaataagacaaggtgggggagaaatcccaaattttgctactcagaagtaactcaaacatttcgatgaataaacttctaaacgtctatatatattcatatgataccaacacttgtttttttttttgagacagagtctcagtctgtcgcccaggctggagtacagtagagtggtctcggctcactgcaacctctgccgccctggttcaagcagttctcttgcttcagcctcccgagcagctgggattacaggcacctgccactgcatctggctaattttgtatttttagtagagacagggtttcaccatcttggccaggctggtcttgaattcctgacctcgtgatccacccgcctcggcctcccaaagtgctgggattacaggcatgagccactgcgcccggcccccacgttatgtgttgtatgtgggatcatgtttctgttttttttttttttttttttcagcaacagtattatgaacatctttccatgtcaatacatggagatatgtgtcataattttgaatggctgcataatattccattttatatacataccctaatttttaaaatctatattcagaatgatggacatttaggttgcgttcatcactgaaacatcctccattaattcttttttctttttattttttactctagcctcccaatgtgctgggattataggcttgagctaccacacctgattggaaactcattaattctccttgtggatatttttacatatgtatttgaatgtctccttgaagtaaatccttagaaatgggatttctgggttagagagaaagcttattttaaacaattccatatcttactgctttccagaaaaattgcattcattttctagtttccccaattagtgcataagaatggccattttctcatacctttccaagcactgggttttgtccatttaaaaatttttgccaaggaaaaaaaatcagttttgttctttttacgtttcttgtttattagtgagattatgtatcttttcatatttttattggcctgacaaatattttggtgttttggctgtagctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgaggtaaagctctctgaagcagtccacacttccttaaaaatttttagaatttcagaacttgtactggtctccactactttatgttgcatacatattcattgttgtatactaaactacttaattttttttagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatggtttgtatccattataccttctatcactttgctatcaaaattgctttgggtttgtcttattgtagatgtaatcttttgaagagagtgtgaccagttcactgaaaactgcatgttaaaaaaattgtagtgatgttttcaatttaaatattttttatttgcatccacattaactctcaacttttcttcttgcccagtgaactgtactgctgagataataatatgtctaccctaatttttagagacaataagacaatttataggcccttgtttattttccagttctatgtgtttatagagtttataggaaaaaataagaatctttagaaatatatgttcttgaaaggtattccataaatgttcttccttttacacttgccttcccagtcttcaatatgagagggaatgaaaagtcaggaaataattgggtgagtaaagcagatatagatagaaacttccattttctttagtcatcttgaaggatatatgtttgtctttgctctctgttgtctgagaaatcagaaaattgaagttaatatgctagccacattttcttaacttctcttggaaattttcaggctaagcctcagctttgctctttgttttttatggtattacttcagtaattattccaaagttctattcattcatgcttgttttgttttggattttagtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggtaagtgtcttagtccatttcatagtctagtaaggtagatagacatgtaaaaatattatgatatatcaatacgtgataaattgaatggtagaaacaagtataaggtacagagttagaacaaaggaaggatatgttaactctctgaagggaggggatggataggacaagcttcctgaatgagatgacatcttagcaggagtttggagaaagaataaaagttagctaggcagtgaaggtagggatgggagactagggaaggtgggaaaggtagtgggtggttactggggtggggaagggcatactgggtagaagagggtttaagaaatgttggcaggtataccactgaccttagcgatcctggtaggttctcagggtattcatcaggaatagttgtatagctccatcagttctaggctgcccccattcatcagtgtgttctcattcatcagtgtgttctctctgtatgacacttctaggggaattcaaagacagttcccaacttctagtagttaataattttttttttagtaggccaggcacggtggctcatgcttgtaatcccagctgaggcgtggatcacctgaggtcaggagttcaagaccagcctgggcaacatggtgaaatcccgtctctaccaaaaatacaaaaaaaatcagctgggtgtggtggtgagcacctgtaatcccagctactcgggaggctgaggcaggagaatcacttgaacctaggaggcggaggttgcagtgagctgagatcgcaccactgcactccagcctggtcaacaagagcaagactccatctcaaaaaaaagttttttgtttttttttttttgatatgtatgtataacatgatctacggttaagacagtttagacagaatgattggaataagtagtaagcctctaagagacttagaaatatggaggctagggtatatctatgtgtacacatggcctcagtttaatttcatagcctttgtaagtggtatagactatactcttgtcagaagtatgcctgattcctaacccttggtttttcccctctatcattacagagaagtttcctgagacttagctcctttcaagtctcagagccaaggatttttttaagcccctactgcaaagttgatcactaaggatatttcaggataaatttagcttaagttcctttagtgtgaaggaatgagttttcctttcaatattatgaactttctttgtgtatttataatattccaatttataggtttaaaagaacactccctctccccatttaaattgctctacattattgtgatgaattttcaattctagggattaaaattgactaacaatctatggaattaaatattcaggagtcatattgtataaattgttatcttggaacaggttttaactactttgttttgagaaaatcctagagatactggcaactgtacatgtgagcttaattcatattcctcgtacttttgtgggatctcaagttcagaggactgagttattcatattccttagttcacggcttattatagtagatctgtactaggctgagcttttcactgtatttatttatttccatttcaaaatttcctattcttatttcctttcccctctccatggacaatcctaatgtatttaatgtatgttctttgtaaatgtctgtgtaaagtgtgtactcttgtaaaatatgtatgttgttggtatgcaggtattttaaatttgcatagatgttatggtattattctgttttttatctcccatgacacaatgtttttaagatttatccttgttgctatgtatacatgttatttgttacacctgattgccaccaacccattttactgctcattaccctaagtaaatggatatgtagattgtatccaactctctgctgctgcagcaaagctgggttgaacttctatgtgagtaagaatttcttgggtatttgtagctaggagcaaaattagtaattatttatttatttttgtttttttttaaagagacagagtgtcaccctgttgcccaggctgagtgcagtggccatatcatagctcactgcagcctcaaacttttaggctcaagtgatcctcccaccttagcctcctgaggagctgggtgcacacgccaccatgcctggctaattatttatttatgaaacagggtcttgctttgtcacccaggctggagtgcagtggcacaatcttggctccctgcaacctctgccttctgggctcaagtgatcttcccacctcagcctccggagtagctgggaccacaggtgcatgctgacacacccagctaatttttgtattttttgtagagttggggttttgtcatgttaccgaggttggtctcgaactcctgagctcaagcaattcacccaccttggcctcccaaagtgctggaattgcaggtgtaagccaccatgcttggtgtgtttttaaacatttttttgtagagacaggtttttgctatcttgtccaggctggtctcaaactcctgggctcaagtgatgctcccgccttggcctcccaaagtgctggggttacagatgaaagtcaccatgtccagccaaaattactaaatgataggatatacaaataccaaatttgattcccctccagtctgtacatttcccccagatgagtatggggactccgataattctacttgtgcagtgacggttggtatgatccagctttgtaatttttgccaggcaaacttctataaagttgtgtcttttactttgcatttctctggtaactcaagtttgaacatttcttcataagcttgttgttagccttttgggtttctttttttatggattttgtttatattatttgtctattttccattggggtttccaatttttttttctttttgctttttaggagtttcttatatattctagacattaaactttgttggttttagacttttattttattttattttattttttttgagacggagtttcgctcttgttgcccaggctggagtgccatggcgcgatcttggctcaccacaatctctgcttcccaggttcaagcgattgtcctgcctcagccttctgagtagctgggattacaggcacccaccaccacgcctggctaattttgtatttttagtagagacggggtttctccatgttggtcaggctggtctcgaactcccgacctcaggtgatccccctgcctcgcctcccaaagtgctggtattacaggcgtgagccactgtgctcagctggttttagacttttaaataccttattttaatttgccatctgattaatttttttcctgggtgttctcagtagacgagaactctgatgtagtcaaactaatcagtttttttttttgtcttctaacttgtgtttcctgagttttgttcaagtagtcctattacagtcttattattcatatttagttctttattctctggagtctgcctttgtatgtccactaattcaagaataggtgctttcccaaagataaattttaatctctggagttcacttccattctcaaatacaggaacattggatttttgacatttaattgtattgcaaaaccttttcttttaaaagtacagataatataagagatctaaatttgattaaaattgtggttcctatggaaatgttttctttgggtggtgattggcataaattaaagaatattaagttgttaacttttagctgggtgtggtggctcgtgcctgtaatcccagcactctgggaggccgaggtggacagatcatttgaggtcaggagtttgagaccagcctggccaacatggtgaaaccccgtctctactaaaaatacaaaaatttgctgggcgtggtggcgcatgcctgtaatcccagctacccaggtggctgaggcataagaatcgcttgaacatgggaggcagaggttgcagcgagccaagattgcaccactgctctccatcctgggtgacagagtgagatgccgtctcaaaaaaaaaaaaaaaaaaaaaaaaaaaaaaaaaaaatatatatatatatatatatatatatatatatagtttttaactatttatgtctatacagttttaagtaacccagttgtcttttgaaatttcaatgctttaattttttcttatttgtagggaaatagtaaagaattgacgtatctttaaatacagtagtgacattttacattactgtattcgtatgttggtttttaatcatggatgctttcttcataggctgtgttcctatttgtttctgtcctttccaagatttctttgtgttattagattattaattgctaccaggataagcctcctgtgaaagtagtgtggagttttccctgaataaaggcaacttttctctgaattagtttctctgagtgaattgtaaatacagcctcctcatgcaaagctaaattgctccctcttgtgcccatagtcaagatgtttagattctttctgaaatgtggaattaatggttcagtttttaactaaatgttatattgtgatggttagagatttacatatcagatggtcatttggtctgtttgcctttttaaagctggtagtgttttctcttttcttgcatgtatttaaatgccctaaatttttagttatacatttagggaaaaaggcctttgaccctaggtaataggtacataaattaaaatatgaaagaatttactaggtagccatatcaggatgctttctttacctttaatcttgggatgatttttacaaattttattttattttattttattttgagacagagccccattctgatgcccaggctggggtgcaatgatctcagctcactgcaacctctgcctcttgacagtccccctgcctcagcctcccaagtagctgggactacaggtgtgtgccaccacacccggctaatttttgtatttttagtagagatggggtttcaccatgttggccaggttggtttcgaacacctgacccaagtgatcccctcgcctcggcctcccaaagttctgggattacaggtgtgagctgctgtgcctggccgatttttacaaattttaggtagtacaaatttaaaaaaatggaaacttaaggcaacagatagtttatttgtctgtttttgtttgtttaaatatttttaaagtagtattttctttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagatcagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccgcctttctattccataaagccgccattgtcatcctggcccgttctcaatgagctgttgggcacacctcccagacggggtggtggccgggcagaggggctcctcacttcccagtaggggcggccgggcagaggcgcccctcacctcccggacggggcggccggccgggcagggggctgacccccccacctccctcccggacggggcggctggccgggcagaggggctcctcacttcccagtaggggcggccgtagtattttcatttaaaaagaaaaagaaataaaagttctccttacttgttcctttttgctttctcctaaattcttaatctttttatttttatttttgagacagagtctcactttgtcacctaggctggagtgcagtggcatgatcctggctcactgcagcctcaactttccaggctcaggtcatcctcccacctcagcctcctgagtagctgggccacaggcgcacagcacgttgcctggccaaaatttttcttttttttttttttgagacagagtctcactctgtcgcccaggttggagtgcagtggcgcggtctcggctcactgcaagctcggcctcccgggttcacaccattctcctgccccagcctcccgagtagctgggattacaggcacctgccaccacacccagctaattttttgtatttttagtagaaacggggtttcaccgtgttagccaggatggtttcgatctcctgaccttgtgatccgcccacctcggcctcccaaagtgctgggattacaggcatgagccaccgcgcccggccttgcctggctaattttttgtatttttttagggacgtggtttcaccatgttgctcaggctggtctcgaaattctgggctcaagcagtctgtctaccttggcctcccaaagtgctgggagccaccgtgccaggctctaaattctaaatcttatcctagagataatcttggttaacaattcggagtaaatttttccaaactttattctctgcaattataaatatatacacatacagaacacagctttaagtttaagtgaagtctcaaggacttgctgtttcataactgcaaacttacactgaaggaggcctgaggggacctcaggaaactttaggagtaagcagtagggcttgtctaccttcttctaagacattggcactgataatcaaaccaggcttcacagccctgtctctacctcagttactgtagagttctctgtctccagttgtttgttatattttagactttcatgcagtcactattcagtacattgccaaattctgatctaagtcttcttctgtcattcctatgtgtttctgccataccctgtagaactcctctgtgagcaggaaactctcttgtatcatcaacttcttagaatattcgccgtcttgccttatctgaaactgggcagtttcctgagtttactaccttctccataaccttcttaagtgacatggcaacttttttcctttatatcctacatactttagcaccaggaaatgggtgggcgttgttcttgctctctgttgtctcatccagaccattaatactcccttctccagctgaatgctttgaggttcatgtctctaacctttcctattgatgtaatcaccgtctcattcattgacgattggagttcgtagattataaccttcctcttatgctctttgtctgttagcactcttagtgattttgatacctgtgtggatgagtcatccaaaaccttaacctcttacctccttaacctctttgtctcctgtgaacatttcttaactcttccctgattacaggctagaccctgatctttgtcattactagaactacagcacttttgaaatcttgatgttgagcattctcttctactctttacccacctccacccattttattcaagtttaatgctatagacttaccaagacttctcatccattgattccagaatatcctctctattcatactatcagtcctctcctagacttcagccatcattgtccatcattttattgtccatcattcagttgcttcttagcacatactcttgactctttagtcctctccttatctggagtgaaaaccgatttttttctctatgctgggaagtggaataggtatttgctcctcaaggcttcatccagaccattgcttacgtcctcttttctgggactgatcctttccttgaccttgtgcaggttcaaagactccatgtcacttcaagttataaaaagtctaattttcataattaatatgtcaagtcctattcagtactccaaacttcatttacatataaggttcagttgggcctgcctgaaactttggaagcctgcaatgggatagtaggttaaggtgggttgtttccagctttttcctgttgcaaacaatgctgcagtgaatattcttgtggatgcagaatagtgtagaagttgaacattgatactttaagtttgaatctcaactctgcttcattagctgtgtaactttgggcaaattactcaacttttctattcttcagtttcctcattttcaaaatgaagataatagtgtctgcttgatagtgtgctataggattaaatgaatgaacatacagagaactcttagaatagtgcccaataaatatctgatgtaaatagatctttgtgcatatatacaagtatctcttttgggtgattaggtttttaaagtagtgatttatatttgtatttaattatttgtgaataccagtaaataaattgccctttggtgtaatttaattcatttatctttgagtctgttttttgctttttttggtatgtttaagatcacataaatctttatgattgatgctactggaatgatctaatgctactgtttaccatattttacacatagggacccctcttttttatatatgtatatttatgtggaggtgattaagtatagtctatgaagacttaagattttggctactgacaatatgtaaataaaaatacatatttcaagatgttttatggctcaattaacaatgatgatgataacagtaataataatcatggccattcctagtgtttactagtttgaagcttaatattggtaagttgctctcagatccataacactaataacctgttttaatcctttatacttaacatagcaatttcacatattttatatcattaatttttcacagcaactctgaaataggtgggctagacagccttatttcagtataatcaatgagactgaggttaaatgatttgataaagattgcttagctagtaagcagtagagccagacttgagtctaacttcctattttaagtctgtataagaaaaccataatgggtgagttatatgttccaggacatcagtagttctcaacgaggggtgatttcacacccccccaggtgacatttgacaatgtttggagacatttttgtttgtcagtactggtgaaggggaatcctattggcatctagtggatagagaccaaaaaggctgttaaacatcctataatgcataggacagtcccttacaacaaagaattgccatcccaaaaagtcagaagtacaaggtttagaaactgtgctgtgcagtgatcactgacaacacaggacaaagatcataaaactttacttggtaagattttcccgataagccacagatttacttcaaacttcagtttcttcacatcttcaacttgtcttagattcaggatataaagcctaccagtatcttgcacgtaaaatttctactctaaatcaagagaagttgaagatgtgatgggattgtaaattggagtaaatctgatgcttaacagtaaaaccatttaaaggagtactcctgttgaaaggccttaagttcattattctttccctcactaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtaccgatggtcaaatttagttggtgtgtcaggtcccatgtcccaataagatgtaactactgacctcttgagaacatcatgcctttttcctgctgttctatagggaggataagagagaaccattgcggccaggtgcagtggctcacgcctgtaatcccagcactttgggaggccgaggctgttggattacctgaggtcaggagttcaagaccagcctgactaacatggtgaaaccccatctctactaaacatacaaaattagccaggtgttggtggctcatgcctgtaatcccagctgctcaggaggctgaggcaggagaatcgcttgaacccgggaggcagaggttgcagtgagccgagatcgtgccattgcactctagcctgggcaataagagtgaaactccatcagaaaaaaaaaaaaaaaaaaaagagagagaaagaaagaaagaaccattgctttcctgcttttctctcttgtatttaaaacgaaaaaaaaaagtggctgccactcggcctaaaattgctttttctctttgcatgctacctaccacatcatctcatatgtaccattgtaggctttcaggaaatgtcttaagtaggtgagttggtgagtggtctttgctagaaagtgcaaacttcttactttgaatccgttatttctaatgggttaacatagaacaacagagaataaatgcaggcaactgataaatgtcaggaaggggccagggacagtggctcatgcctgtagtcccagcactttgggaggccatggtggatagtttgcttgagtccaggagttcgagaccagcatgggcaacatgatgaaaccctgtctttctaaaaaatacaaaaattaatctggtgtggtggtacacacctgtggtcccagctactcaggaggctaaggtgggaggatcacttgagcctatgagattgaggctgcagtgaacccagattgtgccactgtattccagcttgggtggcagaggaagaccctgtttcaattaaaaaaaaaaagtcaggaaggatttttaatggggctcttctgtttgattgtcttagtttctagaaatatacgtgtaactcttctacttccatgtacttcaggagtgagtttgttttgtttgttcaacagttaattaattcagcaaatacttaccattataattatgtgccaggcactgttatcaagtgtttcacagttttcattagccaaaagggagacagcagtttagttgctgcttgtcttaagagtataaccttggattcagtcaacaatttgatttctgtcatcttaacagcctctctttcatttgttcatttaaccaacattgagtgttgtgccaggttctgggccaagtgctgcaagtacaaagataaataaagcattccttgggaatgttatagtatactgagtgagagttaggtagtggctctgcactttttaaaaatgccctaatgcacccaaggatgcagtatactttcatatgtagcagttgctgagtatggcagtgattctcaaattggtaagggtattaatatcagaatatagggtgagaagagtatttttgggaaaagcctactaggtgattctgatgcatattcgttatatttttatggtgcaatctctgctcactgaagctccgcttcctgggttcaagtgattctcctgcctcagcctcctagtagctgggactacaggctccccaccacacgccgggctaattttttgtatttttagtagagatgaggtttcaccgtgttaaccaggatggtcttgatctcctgacctcgtgatctgcccaccttggcctcccaaagtgctgggattacaggcgtgagccactgcgctcggcccctccttctcttgatattgatctgtgtagaggaaataggattgagatcactaacccttccctctttaattgctcagtaacttttccctagttctacttttccttttttgcaaaattaaaattgacttctgttgagtaaaataatgtagccactttcagatgtgtcagactagcttacaaagccaggcatatttttttaatctctcagtctcatttggtttgtgcttttgtaatttttcaacctatgtatgtgcctagagtatttctttatttttatttttatttttatttttttagatggagtttcgctcttgttgcccaggttggagtgcaatggtgcgatatcggttcactgcaacctctgcctcccgggttcaagcgattctctgcctcagcctcttgagtagctgggattacaggcttgtgccacctcgcctggctaatattatattagagacggggtttctccatgttggtcaggctggtctcaaactcccgacctcaggtgatccgcctgccctggcctcccaaagtgctgggattacaggcctagagtatttttttttttgtaatgcacagccatagtgtgtcattcagacaaaaatgttattgtataattatgctatcaggttttagttatattttttcccctcatctgttctagtgagtttagaaaagtttttggagagaacaactgggaactggcatagaggttcttggttactatgaataaacaaattgattaaaaaaaaccacttgtataccaaatgaaaggtaatattcttttagattacaacatatgaaattgctagtttttaggtaaaaaatggtcacatatcatcattattgtatgattcattctaatgctaacctgagctcagttctagtttggttttggtgcttaaagactgagttggaaaatcccattacttggatagtaatggtcgcttttttttttttttttttggcactcagtaagtgatggctgaaccttttatggtaggatctgtaattttaatatgttctgatttagggtttgaggagaaggcagtctctaattttttttttccttatttgaatcagcatattgagaagagtatagcaaagaggaagaatcattttcctagatctagccatctatttgttttaaaaaaaatttaatttggtagattttaaaagacactggtgggattatctttttaaaaggaagcttaagataagtgtcattagtgattaatattttttttttaaattaggtctctcttgatcttggatgatgtttgggactcttgggtgttgaaagcttttgacagtcagtgtcagattcttcttacaaccagagacaagagtgttacagattcagtaatgggtaaggattattcgtttactttttagtacctttatatttaatttaattacatttaaatatgtgacataccaaattacttactttgtcttgtgatttttgtttgcaggtcctaaatatgtagtccctgtggagagttccttaggaaaggaaaaaggacttgaaattttatccctttttgttaatatgaagaaggcagatttgccagaacaagctcatagtattataaaagaatgtaaaggtatggttatttatttgtttatgaggagattatagggagttatataatttcccttttgttaattgagctaatgaatatggtaatttagcacatgaacatccaaaaacttttctgggagatttagtattttaggttctctgatatcttaaatggatacatgatattatggtatttatttattcattaaaataatatttaccatctacccacagtgtgttagagaccacattagtgagagaagtgagacacagatgtgacctctgctgttagagttaaaaatagagtgagaatcagattttaaaacttgtttttgcttgggattttataaaaatagtgttctaatttggtaagtaaaaactggtgtcttaatttgcatttttttttagcgaagttaaactttttacttgtttattgaatacgttttaagaagttatccttgactttaagaaattatccttgactcacttttcttttttgatataagtatttttaatttatttctaaatactcaaaaaatagaaactattagctctttgtcatatttttacaagtattatttcccagtaaaacaattttttaacttaaaatttatatatagaatctcgctgtgttgcccaggctggtcttgaactacttgcctcaaatgatcctcctgccttagcctcctaaagcactgggactacaggcatgagtcaccatgtccagcctgttacccagttttttgtgtaccttttatttgttgtattcttttgacatatagaagcttaaaattttaaacagtcaaatctatcaactcttaaaattatttctttcattattgttatgcttggaaataccttatttttcttctttttctttttttttctcttttgagacaagtctcactctgtcgtccaggctggagtgcagtggcgtgatctcggctcactgcaacttctgcctcccaggttcaagcagttcttctgcctcagcctctcgagtatctgggactacaggcatgttccaccatgcctagctaatttttgtattttcagtagagacggggtttcgccatgttggtcaggctggtctcgaactcctgacctcaggtgattgcccgcctcagcctcccaaagtgctgggattataggcatgagctaccatacctggccaccttatttttcattctgccatcaaatagacacacagttttgtttgtttatttatttatttatttattttatttattttttgagacgagtctcactctgtcgcccaggctggagtgcagtggtgcgacctctgctcactgcaacctctgctgcccaggttcaagtgatcctcctgcctcagccccctagtagctgggattacaggtgcgtgctacctcacccagctaatttttgtagttttagtagagatggggtttcatcatcttggccagggtagtcttgaactcctgacctcgtgatccacctgcctcagccacccaaagtgctgggattacaggcgtgagccaccacacgtggccagttttgttaatttttaaagaaatcttacacttagaaaaaatgcttaatttgtagttattacaaagggtgatgcatgtccattttgaaaatgtgtgaaactaaaaaaaaaatagaaattatccataacctgataattattagcatcatgagagtattgcctccagtcttttagaacaaagatttaaaaagttgagattatgtatatgtggttttggattttgcccttttttttttaaagagccagggtcttgctctgtcacccaggctggagtgcagtaagatcacagctcactgcaggcttgaatgtcttggcttaagcaatcctcctgccccagcctcctgaatagctgggactgcagatacccaccaccacacctgggtaatttttaaatttttttgtagggacagggtctcactatgttgcccaggcaggtctcaaacttctgccctcaagcaatcctcccacctcagcctcctgaagtgctaggactacagacacatgtcgccacacccagctggatcttaccctttttctatatcttgagcattttcccatgttgttaaatatttttttgaaaaaaatttaccagtggcataatattgatatatcttaatttattcaaccacttctgtattattggacattgtttacgttgtttaagattttttcactattctaagtgtgctgtgatgaatatccttaaacttaatcattcttttctttttctttaagacagagtctcacactgttcctcaggctaggatgcagtggtgctgtcatggctcaccgtagcctcaacctcctgggctgaagcaatcctcccacctcagcctcctaagtagccggcactataggcacacaccaccacacctggctgatttttctaatttttatttttagtagagacaaggtctcattatattgcttagactggcgcatatatatatatatatatatatatttttttttttttttgtaatgacatcttagccagatttgatctatgttattttgacttaataaagataatcaggaacttactgaatgaaatctttcttatttctaattttttttgggataaatatctagaagtgaagtcaagagtgataaatacttaaggcttttgataacatgcagcagaaattgtttcttagtaatgtaagtaagtaagtcgattcttattagtgacaaaataggatggtattagcatagtgacttcattttttttttaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtaatgggatcaatgatcctcatcattgggtatttattgcatgtaagctttgatatagtactgagcatgttgttacagagaaccttggaaggataagacccaggggactgaggtggtggggtgttgggtgtagaaatccctctgctgttagcttccattaagggctttgtgttgaactcaggagttaacctatttctgtggttctagtgcagctgaagaagcatctgacttctctttctcttttctatcttgaggagtagctgagtttcttcttaagaaatggagacattcttactcagggctttaagataccgtttttttgtgtgtgtgataatacctgtctacagtcctggtcattgtacttttgtggcatattaaatacttacaacaattcctaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggtacttgcatcttggtttacttttttttttcctttttcctttgaaataattttagatttattgaaaatttacaaaatagtagatagtttctgtgcataagtccttcacctagcttcccctaatattaacattttatataaccatagtacagttgttaaagccagaaaattaacattgatacaatactgttcactaacctacgtgttctttttgtagtccaggccaatttaggatcccgtattgcatatgattgtcttgtttccctacttgtcatttttttccgtctcctcaaatctgtgaaaatttatcagtctttatctttcatggccttgtcacctttgaagagtactggctagtaattttgtacagtatacccaaatttggttttgtgtgatgtttttcctgactagattgaagttatagatatttggcaagaataccaatgatgttgtatctttctcagtggcgtcataggctgagagtacttggtggtttttaaaaaattttttgtagagatagtgttttgccatgttgcccaggctgttcttgaactcctgggctcaagtgatccacctgtcttggcctcccaaagtgctgagattgtaggtatgagccactattcccagactcctggtgttgatatgttttattatgggtgatgttaatgttgataatttgtttaaagtggtatctgccaggtttctgcactgtaaagtcattattttgtggggagattctctgtatatatatatgtatttttttttttttgagacagggtcttactgtgttgcccaggctggcatgcagtggctcactgcaatcttaaactcctgggctcggttggtcctgagtagctaattcccgagtagttgggtctgcaggcatatgccaccacacctgactgattttttttattttttattttttgtaaaaaaattaaatatacggatatctctctatgttgcccaggctagtctcgaagtcctggcctcaagtgatcctcctaccttggcctcccaaagtgctgggattacaggcgtgagccaccgagcccggcctctctgtacattcttaatagctttggaagctgaagttactgtgatgcttaggttataaaattgtttctggcttctgaaacgtttcattgggttgcaggatctacataagaagataatcactcagtttcagagatatcaccagccgcatactctttcaccagatcaggaagactgtatgtattggtacaactttctggcctatcacatggccagtgccaagatgcacaaggtaagatgacccatttaaaaattcttttatctgacttccctttttccatatgtattacaaataagtgctttttttctgttattttttgtcttgaattttgttcatattgctttccatttgattttttttttttttttttttttttgagacagggtctcactttgtttctcaggctggagtgcagtggcacaatctcagctcattacaccctcacctcctgggctcaagtgatcctcccacttcagccccccatgtagctgggactataggcacatgccaccatgcctggctaatatttttgtatttttggtggagatggggtttcactatgttgctcaggctggtctcaaactcctgagcttgacgtgagctcaagtgatccactcgcttcagcctcccaaagtgttaggagtacaggcatgagccaccgcggctggctgaagatttgaatttttatgtagttaaatttaccactgttgttgtcgtcgttgtttggtattttgctttgctgtcctgttcataaacatgtattgttttattagtataattttttattagtaaaaatgggattatagcttgcataattatttttgtttttacctgtagtgattagaaaaggtaccttagtaactagtaaatgaaccacctcagaattaatcctcttcttactagtagctttcctttttgggcagtatggatttgttttgtaagctttgagaggaaatggatagtggaaaagtatattcattgattcaataaatatttattgagtgcttgttatgtatattgctcttcattaagaggataaagcacaggcacaaagtcattgctctcacgagtttatgttctgggaggaggcagacattaaacaaatttattatatttcagtgggtagttaagtgctcagaagaaggacagagcatggaaggggaaagaaagtgatgatagaggggtagaatcatcatgatttgcttatgggtttggtatgcattatacgagaaagagaagaatcaaagatgactccaagaatcaaagatgactcaaaccccagtggaaagaacggagtccatgaactgaaacaggggtctttgggagaacaagctttttcctgcagagaatggggatggttaagaactcattttggatatattaagtctgatatacctattaaggcatctggctggaaatattgaataggcagttagatatatgagtctagaattctggggagaattatagatgaaagatgaaaataaggaattattagcacatagatggtatttgattgaagtcatgactaccaagtagctactaaaaatgtttacatttggaaaaccatatgtactttcagtaaattttctatgctcaggtatgttatttcttggttatgatacatagtaaattgttgtagtttgtttttttatctagcaaaatatatttacatttaatagtgtatattggaatgatggtattccaataaatacttgtgccctaatttacttaaccaaactctagttatcgaacatttaggttttcagtttttttggtccttatgatgtaatgagcattcttgtttatctttgtacctatgttgtttccttggcaaattccgagaagtagaattactgagccaatgcatctttttaaagcttttgacatgtatgatagtgtggcaggattcagtttctctttagccttttttctgactttaaaggtaatggttgattttcattggaaaaacagaaaaaaacgatgaaaaggaaaacagagatcacaaccattactaatgctcttgtgtatagttttctagatcattttgctgcttctataaacatacttgtctcttaaaaccaaatgggatcataatagaaatagtctcatatattgctttttaccatttaattacattgaatggtcatcttttcatgtcatttatatagagtgacatgatttttaaagctgcatattatttcattgtatagctacattatgaatggccagttggttgatggacaattagattgtttaagcatattcatctggttattttcttaggatacttttttataagtggaatttctgggtcaaatagtatgtgcagtttaaattttaatacagattgccagactgctctccagaagggtaccctgttttacatgcctaccaacagtggttgaaagtgttcatttcctctgattctagctaatcacctcctctcctctcctccctcccttcccctcccctcccctcttcctgccctcccctcttcctgccctcccctcttcctgcccttgccctttctttgacaggatctcaccaggatgtcactctgttgcccaggctggagtatagtggcatgatttcagctgaaatcactgcaaccgccacttcctgggctcaggtgatccttccacctcagcctcctgagtagctgggagcacgggtgtgcaccaccacacccggctaatttttgtatgttttgtagagttgaggtttcactgtgttgcccaggctgatcttgacccctgggctcgagtaatccaccctcttcagcctctcaaagtgctgggattacaggtgtgagccactgtgctcagccccagctaatattcttgttactcctttagtcttcagaaatctgatactttaaaaatggtaaatttttcttgttctcctttgattaccggtgagattttggccatctgtgctttttgttttgtgaattgtggctcccatcctttgtttgcttttacctcctttacctattttttctcttgacgtgtttttctttttcttactgttttattagaattttctataaaaaataattttctataaaaataaggattgaagccctgatctatcatatgtgttacaaataagtatttttttaaaacttctttggtcttgagtttaatttatattgctttctactgtattgaagatttgaatttttatgtagttaaatacacttttatatagttaagtgcagtttttctttttgtttgatattttgctttggggtcatgtttacaaagatttccttcactacaagcttacaaaaatatttatttttattttctagtatttttaaatgttttctattttctatttaaatttttaaccaactggagtttatttggagctgaagtatgaggcccattttatgtttctttggaactatggatgtgttctttctcactagcttttgcatcctttaaattctagatatttactgtttctcttagcagtgtgaggttaatgatgttatacctaaaattttttgatctctaacagtgctgctgatactactttttgttttttaaaggaactttgtgctttaatgttttccctggattggattaaagcaaaaacagaacttgtaggccctgctcatctgattcatgaatttgtggaatacagacatatactagatgaaaaggtatatatattaacatgaaaaattagtgctaaaaaggaatctcatttttttttacatttaattctagatttaatgatgggaatgagcagaatagaaggggtgaagataatttccctcctttgatttttggttattctaattaatttgcttcctaccctactgggaaagtaggtaggattgaagtttaaaagctaggaaaataagatgttcagtggtttttttaaaaaaagaatgtattaagaaatgtgtttgataatgagatttttaccctatgtttaaaagtcagaagaggattactatatatttgttacttaatggttggctgttcaattttagttcatataaagaatatttcatttaagcttttaaagtggcaagatcacagaaatggaaaaatgtcagatcgtggctctgattgtgtttctaagagatttcagtttatttgtaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggatgtaagtaggttaggagagaaaccaaagggagtggtgcgctaactatatcattatttttcaggtggtgaatacgatcactccaggaggatttaactactttcgaaagggctggaacttttaataagcattcttacttattgaaaagttctagagaagtaagcataggagaaaatgattgtattttcaaagaatccatataaatagatgcctgtaaggcatttggacaaattatcctaagtattcagtactaagtgcttgacttactgtaatttagtatagtggtgaggagcatggactttggagccacagaactgggtttgagcctcagttctaaaacctaataattctgtgactttgaacaagttacaggtttttctctcatatgtaaaatggagataacaatcctttgaaataagtgctgtttccatgaagattttatttatttatttatttatttatttttgagacagagtctcactatgttgccaaggctggagtgcagtggtgtgatcttggctcactgcaacctctgcctcccggattcaaacgattctcctgcctcagcctccaaagtagctgggattataggcgcccaccaccatgcctgtctagtttttatatttttaatggagatggggtttcgtcatgttggccaggctggtctcaaactcctgatttcaagtgagctgcatgcctcggcctcccaaagtgctgggactacaggcatgagccaccacgcctggccttctgtgaagatgtaaatgagataatggctgtaaagtaatttgcactttcctttgcacatatagtccttattaaatgaccactgaaccctgattattctgtctcttaaaggagtctcttttgctcttaccttaatcttgtaaggaaaggtataatcttacctttccttataaaaaggaaaggatagctattaataccatctttttaatgcctgttataatgctacataatcaagttattctatttaatcttcaaaacaagtttataaggtaaattttatttttattttattttattttattttttttgagacggcgtttcactcttgtcgcccaggctggagtgcaatggcacgatctccgctcacggcaacctcctcctcctgggttcaagccattctcctgcctcagcctcccgagtagctggaattacaggcatatgccaccacgcctggccgattttgtatttttttttagtagagacagggtttctccatgttggtcaggctggtctcgaactccagacctcaggtgatccacccgcctcagcctcccaaagtgttgggattacaggcgtgagccactgcacccggcctaaattttatttaccttataaaaatgtaagtacctaaaattgacctctgattatacaaatgagaaaattgaggcacagaaagatttggacttggctaagttcatgtgacttgctgaatgggatttaaaccttggatcttgtggctgggcatggtggctcatgcctggaatcccagcaatttgggaggccgaggcgggcggatcacctgaggtcaggagtttgagaccagcctggtcaacatggtgaaacccatctttactaaaaatacaaaaattagctggatgtggtgaattgtttgaacctgggaggcagagactgcagtgagccgagattgtgccactgcactccagcctgggcaacaaagtgaagctctgtctcaaaaaacaaaaaaaaaaaaaacaaaaaaaaaaccttgggtctgcctggctttattttgcatgctctttccatatgtcatgcttcccttacagcttgaaataataaatatgagtggctctcttttcatatgtataatttatatctaaatagaagtccaggttggtatctgtgatctttatggcattaggccctctttccaaataagtcagactactgtaggtgattttcttgattcagtttagttcaagaagcgtttgagtttctgtactgtgctaagcactagcatttgagtttctctactgtgctaagcactgttactagatgtgaggtctttcccctaaggagttcaaaatctcgtagtgaagaaaggagtttaggcaaataattacaatataatgcaatgagtataacaacagaactatgtataagtagagatagaactgataagtatttggcttggaaaaatgaggaattcaagggagggttccatgaaggagagaatggtatctgagagaattaaaattttttttttaagttaaaatgtttaatttttgttggttttatttatttatttattttgagacaggacctcactttgtcatttaggttgagtgcagtggtatgatcactgctcactgtagccttgacctcttgggctcaagcaaccctcctgcttcaacctcctgagtagctgagactacaggcacatattaccatgcctaattttttatttttttgtagagataaggtctcactatgttgcccaagctgatctcaaattcctggacacaattgatcctccttccttgacttcccaaagttcttggattacaggcatgagccaccacacccagcaggttttattttaaataatacattcctgattaagacaaaaaacaatagtaataggatgtaagatgaaaagtcaaagactagccatttccctcctaccttcccactttccagagttgaccattccttaatactttcttgtgaagtggaggtctctctctctctctctctctctgagaagcagccccctaacttactgaagctagattagatctgtctgtattcgagagaactgtttgccccatatcataggatttgtcacactttatagtgattatctgtttacttggttttctctcatactagtccatgtgttctgaagtatagaatagtttggaggttaaaataacataccctggctctagactgcctgggtttgaatcccagctctgctattgattagttgtgtatcataaggggaaagttatttaacttcctttgcctaatggtagtattttatagcattgttgtgaggattaaattagtgtatatatgtatataaacgtatagacatacatatagtacttagaacagcacccagttcatagaaagtgctcaataaatattagttgttattaagaatagcatttagcatttttctggtctgtattcagtataaatttatggaagattgaatgaactcatgtttcagttagtggctgaaatagaatcttaatacttggtctgatcaaagggcataggtttagttcttgttctcttatgaattgttgagtttcttcctgttttctcccattgcatcaactgcatttctccttgtgatgttctctcatagaatggttagctatttatagcttatttttaaattgtgtttgaccagtccatattcaaagaatgctttatttaagtactagaaacttttttggtgtttactatagaaaggtttaggttggtataagcttaaatttaattgagtttctgttttcaatgaaattatttattcactcattcatttgttatttgtctagtacttttgggccatctactatatatcctttattatgaaagtcactttctgagctttgaggaattgagtagatagatcaagcagacataaagaacattttaaaatctaatcctcttaactttgctagaacttatctgttcttctagttgtcatcactctagttcttatattatacagtcgaccctccatatccgtggttctatatccatagattcaaccaacctggattgaaaatattagaaaagaagtagatggttatgtttgtattgaacatgtacagactcttttcttgttattatttcctaaacacgatggtattacaactgtttacatagcatttacattgtactaggtattttgagtaatctatagatgatttagggtatacaggaggatgtggtgggttacatgcaaatcctataccattttatgtaagagacttgagcatccatggattttggtatctgtagtgggtcctagaaccaatccctcatcaatactgaggaacaactgtacttgtttgttttatcacttctactaaagtgtaatactttgtaggcaggatctaaatatgatttacctttgtgttcacttttatcacttgatctgtcttgtgtgtggttaagttttttgaagaatgatagtagtggcacctttatgtgtcgggtgctgtttagaatagataccattacttccatttgacatatgaagaaataaaaacttgttaggttaagtaatttgctcatttacacacctaataagtattagaaatgaggttaggtttgtctgactgccaacccttgatttctaaaataagcacaatactatttgacatatttacttgtactcaaagtgacagggatgtaacgtatatgaaattctgtcactgcactaatagttttttctggtttaagtatacattacattcctttacaccttattatttatttatttatttagaaacagaccctcagtcacccaggctggagtgcagtggtatgatcttggctcactgcaacctccacctccagggttcaagcgattctcatgcctcagcctcccgagtagctaggattacaggtgtgtgccaccatgcctgctaatttttgtatttttagtagagatggggtttcaccatgttggccaagctcatctcgaactcctgacctcaagtgatctgcccgcctcgtcctcccaaagtcctgggattacaggtgtgaaccaccatgcctggcccctttatactttagatactatgagcagtaatataatatctatactggtggaatagttgatattcattagattgagatacaaagaatatgatgttgctttatctttttggtatgtctgaataattgtagtttgagagaagcagttttttttttttttgaaatggagtcttgctctgtcgcccaggctggagtgcagtggcgcgatcttggctcactgcaacctccatctcccaggttcaagcgattctcctgcctcagcctcccaagtagctgggattacaggcacgtgccaccacacccagctaatttttatctttagtagagacggtgtttcgccatgttggccaggctggtcttgaactcctgacctcaggtgatccacccaccttggcctcccaaagtgctaggattacaggcatgagccactgcgcctggctgagaagagcagctttaaagtacatcataataatggtgggtgtttccttcagttaggaaatgagcattttgctatgatttttattttaaaaaagagatggagaatttttgaaggtatccttatataatgatttatctgcacatgtatcattattaatgtatcaaaggaaaatggaaagtgacatgttgattaactagatttgattaatttgattaattagatttcttccaactcagtgacatttgtaacacgtgacaggttgcttgataaagggtaacatttctcttacaaatgctacttttgttattttttttcttttggtgatctgtgctgtcatttgcatgttagtaatctgattttaagaattttgtattttggggaacataaccatgttaaaagacagtttattttagtactgaaagaaaatagttacttttactctcatttatttaatttctgttcattttttccctgtatttagaaacaaaaaaaacatcacgaatctttcccgcttagttgtccgcccccacacagatgctgtttaccatgcctgcttttctgaggatggtcagagaatagcttcttgtggagctgataaaaccttacaggtaaaacacatctcttgagaaaaatgcaaagaggcatgtatccagttttgtgcagatcagaatatgtttaaatcctaaaattcaagaaaattgcaacttagaaataacagaggaatccagctctcttgaacattttattaaaggtttctctagagatttaaaagatacagttacatgttttcctaattctaaacttacaggtggtaaggaagtgccctttaccctgccagtcagttcccagccatccatttgtcagctaagggtagtgaggaaataattgttagaagacgtagggcttcatagcacagggaatagggctgtgattaaaaaacagtgattaggaaaatacctattttatcaaagtcttaggcataggtttttttcttgtaaataggaactggactagactatttcctaagttgttttaaagaatttcctttaagattccctttgttttcagaaaatattaatgagtacttttctttatgtttgtgttctgccttttgattttgcagagaacatgatgaaattagttaaaacttgtatttaggatacttttagtctttgcaagattatgactccatagcttatgtctatatgtgtactttattactaattttattaatcttggcttttgagttccagagagaatgcatattaaatgaaatgttttatttgattgttaagaatttgccaaaatagtctcaagagctgaagctgtgctctgacacttctttttgatggcagcggcgggctgcctggagtggctgctgccatcatgctggctgcagcagggaggcgcagctggggctgcatgctctgtggagctggcggtagctggggacaagcaggaaccctaccccttctgaattggggcaggagctcctggttcctgctgtagccgcccaagccacagctgtggacctgggaacccgctccatggagcaggccagagccctgccctcctgggtgtagctgtagccgcccaaaccacagctgcaggctcgggcctccggctccacagagcaggcaggaccccttccccctggtgcagctgtagctgcccaagcggtggctgcagactcaggcatccctgtactcttgggggacctggaaggaccccctgcccttgtaggcttggaagtgcctgctcccgctgcctgacttctccctactgttggcacccactctgatcttagagcaaagctggggctgagcctgggtgctgttgcagcccggccagatgtgcacatgcttggggcagtgctgacatgccagccccctgccgcctcggccccctccggactttgggtgctgatgagcataggagggaagccaagggggtgctgagggcagtttgatactggcctgcaggctccccttggcacctacagcctgggtgccattcatggcagcaggaggcagacaggttcctgggtggaagggggcgggtcaccaatgaggccccaccttcaggccacaaagggcctgaagactgggggctgggctgctggtgtggactgaatggactggagtgggaacttatagtgccttttccaggcttgcccatgtctgcccatggaccagttggcatgtacttcctcccttctgaagcccataaaagcctcgggcttagccagtgctgagcagacactgggacaaccagctgcagagaggagcaacccactctagtgccccctctttgctgagagctgtgcagatgacaggaggaccagctgcagagaggagctaccctctctgctgatagctgaacacttgtcaggaggacttgcctagcagagaggagctaccctctcctgagctgtggaaaggagctgccccccgcaggtttattgagctattttatcgctcaataaagctcctgtttgtcttgctcaccttccacctgtcagcgtaccacattcttcctggttgtaggacaagaacttgggatcccactgaatggtgaggctaaaagagctgtaacacaaacagggctgagacatgccccttgcttgccgcattgcaagtgaagataagtaaagaaaagctgcggcccttcggggagcccagacttgggagctccccaagctagggctgtgactccctctttggggccccgcggttcctggcatctccaagcttctgggcaccaccgtgttccccggtgccagcgtgtaagctgcttgtggtgtgcctggtccagccacagcctcacagagagccagagcccatgctggcacctggagctgcctgccccgctgcagcagtcagcacgtctgtgcgcagtggctggaccccacgctcactcacacacgcctcgctgttccacgcctgactcgcccttggcaggcttgggacccaggctggtagtgtgagctgaatgcagcctgtcaggccaagtgggtgaaacaagaccagtgggcccaagcaaaacttgggcaaaggcgccaccggccacagaagtttctggccagaaaatcaacaccccaaagatcctgtaacattttcattgatatttacaaacatgtaacagtgaatagttctctagttatgtgaaggcatacacattctgacagaaattctgattttgggagtagctttgccaaggttcctttctgttttgcaaaatgacaatgattaaactcacttaaagatttttattgaatgatgaccagtagttaagcagtttattataaaaaatattttattgttacttgtgcaggtgttcaaagctgaaacaggagagaaacttctagaaatcaaggctcatgaggatgaagtgctttgttgtgcattctctacagatgacagatttatagcaacctgctcagtggataaaaaagtgaaggtaggaaaatcttttcctcttgagttgtaatcacaacagaattcattttatttttccatgatcatgagaccagagtaagtagagttaaaggactctcacctgttgatctactaacctgattcattgtaaattaacactatctgaaaattctttacttttttttaaagagacaggattttgctctgtgacccaggctggagggcagtggcatgatcatagctcactgtaaactccaattcctgggctcaagtgatcctcctgccacagccttccaaagtgttaggattataggtatgagccactgtgcgtggcctgaaaattctttatttttaaacaccagcaaaaatgcctaggttgatcacctcaggattaaacaagcagtggggaaaagcaatgacaaattagtgagtttgtcttccattaatagacaagtccatgggttaaatatcagttgaaatctttgagtgcattgtgattaggagtgttgctgcacaaacttggggattcctgttgtaagatacaattttaaaatgcaaccccaatttttttaatttgcttatgaactggcttatatattcagtggaaaaccaggtggatgaacaaactaataattacgttactggtctaaaaacataaatagagaaaagtaaacagagtaatttttacttatttattttgaggcagagtcttgctctgacacccagactggagtgcagtggtacaatctcggctcactgcaatctctgcctccaggattcaattgattcttatgcctcagcctcttgagtagctgagatcacaggtgtgcaccaccatgcccagctaatttttgtagttttggtagagacagagttttgccatgttggtcaggctggtattgaacttctggcctcaagtgatccgcctgcctttgactcccaaagtgctgagattataggcatgagccactgtgccccgccagagagtaatttttatttttgttaagtattctcttgttcctaaatttggcttctaccaggagcatttatactaatatagaattcaagagaaactgaaggcttgtgggggttatcactgatatatggaagacagaccttactttaaccctttttcaaaggggttaaatctggagtactggatgtagctaggtggagtgggcaagaaatttgccttgggtgttttcctgaagttttcacctactggaagagggctatggaatgtccagactaaatttgagaccttggaaaaatctacctcttgatagattggactcgtggcttaaccaacagttaattcactctgtagtgtctactctgactctgagtcagacttggaggtggccactgagggcagttctaaagtcagagctacatggagtaaaaggaaataataatgagtttctgttttctaagccagaggtagaaatacctattaaagaactttaaaataagataaactctctggacctctggggattctaatcagtgctttgataacatacaaaggaaatgccaaaggacattagtacctctaaaaagtcaaaatcccagtgaaggttcattaggtaatttatttcttttgtttgttgttatatggcatagactgcttagttgtcttacatagtaactagaatgatgattaatttttttgtttttttttttttttttttgagacggagtctcgctctttcgcccaggttgaactgcagtggcgctatctcggctcactgcaagctccgactcccgggttcatgccattctcctgcctcagcctcccgagtagctgggactacaggcggccgccaccgcgcctggctaattttttgtatttttagtagagacggggtttcaccatgttagccaggatggtgttgatctcctgacctcgtgatctgcccgcctcggcctcccaaagtgctgggattacaggcgtgagccaccgcgcccggcctgatgattactttttactgaaaactgaacactataagaggctataaatactacacactttgtcatattacattatcaatttcctgctacagcttgcagggttaagtgtcgatcccgtttacagaagaggacgcagattcagagatgaagtctcttgctcaagcttacattaaactgggaacagtaatagggttgaaagctgggtttctctcagactataaaacctttattttttttaactaagcaatctgcctttacttatttatatggtaccttgaagtccatagaacacttgtcatgttcattatctcatttgatatcttaaattgtgtgggagaggtatagatatccccattttacagaagagggaactgagatgcaggtaagttagggatttgtgacacacaagtcataagtggtagagccagctcttgggctcaacccttctgaccagaaatctattatgctaacctctttaaagcacttctctgcctgctttcattcatataaacatgtgaaatcttgcccttaagaaatgtcatgtgttcatgacactctagttatgctataggtacatatatgtatatttgcaaataattttttttaaacattaaggcaaaatattgccatattttagaaaggggagaggtttcattagcatcttgtccaactaggaaaatctgctatgacaggataagatagcatttgcaaagcaatggacattgctttgcccctctgttctccctttgaaaataatggatatttgtaaattttttctcttttctctttagatttggaattctatgactggggaactagtacacacctatgatgagcactcagagcaagtcaattgctgccatttcaccaacagtagtcatcatcttctcttagccactgggtcaagtgactgcttcctcaaagtaagtgtggatattgagaattaggtagataaatttgattcgtacatcagagtatctcctttgattttcttatgtatactactattaggactttctggtcacaatgatagaaactacaataatatattagctgaagcaaaaaaaaaatagcttaaaaatattttattggctcatgtaactgaaaagtctagagggagcatggcttcaggcatagctgactccaaatgcttaaactgtgttctcaggctctacctccctttccatctccagagtcttgacttcctctgtgttggttcaggcatgctctttctgtggcagaaaatgtggctaccttacagctcacaatcacagagtaagagaaatgtgctctctcctagaacccatagatctaattttagagaagcctttatttgactcattttggcttacatgctcatagctagggtaaccccagtggacagtaggatggaatccttggattgtccaagggtcacaagtttagttatatggaagtgggacaaatgagtgaggtcaactctacttgaatcgtaagtagagcttaattcaaaagagagttctgttatcacagagaggagggagaaaaggtgctggtaggaaagataaccaaaaacagaaattcattccacatatgctttgtaatgtttgattgtatctttttttcctcttaagtggataaagatagctagattaccttttctggaatcccagaaagatctgctaactttttttgaattgttttttggtttgatttcaaacctttcttccttgataccataccatctttgcaattgaacatgatatttttgagaggggtagtaaaagacatttcagtttggaaaacttcatagactctatgttttgacatttaaataaattattagaaaaattatctttagaaagtactgaaacagttattgaaaattgccgtctccatccccctgttcaggaagctaaatttttatttatttatttattttttcagaagaaaaaattatacagaagctcagtgtgtataagagttaaagcttgctgctctggctgaatgggacctacatttcttcttgactctctcttcctccccctttccctctcctctctctctctccctctatccctttcccttcctgtcaccttcccttcctcttgaccttcctttctctcctcctccctctcttcttctgtctcctcctcctcctccctcctcctccccccaccccccctctcattctctctcattccctttcatctctaacctctccgcaccacatagtgctctttaggcatatttatgtttatagaatcccaaggaccctgcagagcacaatttgaaaacactggattggaccaaaattacagagtaatgtagtaacataaaattatatcacagttatggttcacttttactcaaaaaaacttggccctatttgaataaatgtaccactaaaaaaaaataagactgttatactatttacgactaatttttgatgttgcttttggcattttgtaggttgaggaaataaatacaggaaaaaacctctgccatgtgggagggggttattggttagtaagccattttaattaaggacaaggtttactttaagatgtgctatactacctatattaccataaggactattaggatgcatttcttgtgattcttgagcagagagaagccagtgaaaatatgtaattgtgaagctgccttcatgtaacttgctttatctgaagaattgagtttatctaggactgggataaaggagtcaaagatagaagtggacatgaggaacagtatatatctcacttactaatcatttctaaataatttttgccaaaactaacatttagcaataattgatttcttcttctgggtttaatcttattagcataaatcaccagagatgactataatcccttttatttgcattttttatactttccaaacctacccaaagagaggagatataatataaacccctgtggtatccatcatttagtttcaacaattatcagtattttgtcaatcttattttataaatacccctcccttttttttttttttgagatggcatcttgctctgtcgccaggctggagtgcagtggcacgatcttggctcactgcaacctctgcctcccgggttcaagcgatttccctgcctcagcctcctgagtagctgggactacaggtgccgtgccaccatgcctggctaattttttgtattttagtagagatgggttttcattatgttggccaggatggtctcaatctcctgatcttgtgatcgcctgcctcagcctcccaaagtgctaggattacaggtgtgagccaccacgcccagcttataaactcctccacttttttgaatagagtcttcctctatcacccaggctggagtgcagtggagcgatcttggctcattgcaacctctgcctcctgggttcaagcaattcttatgcctcagcctcccaagtagctgggattacaggcatgggccaccactcccagctaattttttgtgtttttagtagagatggggttttgctatggtggtcaggctggtcttgaactcctgacctcaggtgatacgcccacctcagcctcccaaagtgctgggattacaggggtgagccgccatgtccagcctgaatagaggattttacagcaagtcctaaatatgtcatttcacccaaaatatttaagcatgcatctcagagatcttaaatataaatactatgtttattatcataccatactattatcacacctaacataataaaatatagttttgtaatatacttggtccatgttcacttattccatattctcaaaacatgcatttctatcatgtttgttggaatcagaatccaaacaaactttatgtagcatttgttctgcctcttaagtctcttttattctattaaagttccctttttcctctgactgctttcttataccattgatttattagagcaatttagtcatttgtcccatggaatgtgccatattttggatttggttaattgcttcctagaggtggtacttgacttgctccaccatttttagggttggataacctgacatttaaaaaatatgggggtaatttatattacatattacttattgtggctttttgtaactgagtaaaataataatgattctaaaccactccgttgaaataagtagtaattgtttagttagttatttagtactcagcctaaaaacctcggtgagcctttgagtcccttagtcgatttacatgctgatctaaaggctgccccattgcttgttaatcacaagttcatttttgtgtttgatacgtttgtgttactgtgaattaaacatcattctgtaatcaaaaagcttaaatgagagaaaaggaagaacttcacatgatttctgatgtttccccactcaatactagttgtttatttatctttttttctttcacaaatagctttgggatttgaatcaaaaagaatgtcgaaataccatgtttggtcatacaaattcagtcaatcactgcagattttcaccagatgataagcttttggctagttgttcagctgatggaaccttaaaggtatgcttttgtacactattaaaataggttgtattttatggaaagtcttatgatttgattatagaaataggtttctgttttttcacatttctacagaaagagcctgcttctttcaatttccaggagcatatttaatgtaactgtaattgcttatcgtaatgattgtttatgaatggtgtacaacctaatgcttaaagttctataatgtaggctgggtgcggtggctcacgcctgtaatcccagcactttgggaggccgaggtgggtggatcacaaggtcaggagttcaagaccagtctggctaagatggtgaaaccccgtctctactaaaaatacaaaaattagctgggtgtggtggtgagtgcctgtaatcccagctacttgggaggctgaggcagagaattgcttgaacccgggaggtggaggttgcagtgagctgagatcacgccactccactccagcctgggcgacagagtgagactccgtctcaaaaaaaaaaaaaaaagttctgtaatgtagaatttttattcttttaatttgaattcttaaattttaagtgtacattttgtttcaagcatatgttcataaaatattttgagatctgttttagtttattttgtgcttctataatttatgttgtgcttctataaattgtgagtaatttataaagaatggagatttatttcttacagttctgggggagagggtaccagcagagaagggagagagtgaggaggcggctgaacttatccatttatcaggaacctaggtaatagcattaatccattcatgagggtagcgccctcatgacctaatcacttttgaaggtcccatctctcaatacttgcatcagggattaagtatttaatacatgaactttgggggacacgtttaaaccacagcaagatctatgggtcaggtttgtaaaggatctggcttttgtttttgtttttgtttttgagacagtctcactctgtcgcccaggctggagtacaatggtgtgatcttggctcactgcagcctctgcctcctgggttcaagcgattctcgtgccccagtctcccaagtagataggagtacaggcgcctgccaccaagcctggctaatttttgtatttttagtagagacggagtttcaccacgttggccagtctggggacctgtttttacttataatttattcattctgccttttatattattgctttcttgtttttgagaagccacaaggtaggaaaaatgcaagagttagggaaaaaagcttattcagccttctgaaatttataggcctaaaaaaatgaaataattcttcctcaaatccccaccttctccaataagattcccaattccactttattattcctgtctctattgtctctcctgtttattgactgtcctttctttctttggtcttaagatcaacccatctttgacattgttgtctcttggtctacatttttccctcttgttctgtagtagttgctctagttcaggctgttgtctgctcatgcctgatagcaaccatctaagatgcattctgcatctcttcttatctaagttcagagatactagaataaccttctaccactgttttctttcttttttttttttttttttggagacagagtctcactctttcactcaggctggagtgcagtggtaccatcatggctcactgcagccttcacttctggtctcaagcagtcctcgtacttcagcctctcaagtaactggaatcacaagcatgtgccatcacacctggcgaaattttttttttttttttttttttagagataggatcttactatgttgcccatgcttgtctccagctcctgggctcaagcaatcccagtgctgggattataggcgtgagccaccaagcctagcctaccactcttttcttttttcttttcttttctttttctttactcttctcttttctttctttctttcttttttttgaaacagggtcttattctgttgtctaggctggagtgcagtggcctgatcctggcccaccacagtctatctcctgggcttagatgatcctcccacctcagcctcttgagtagctgggactgcaagtgcctgctaccatgcccagctaattttttgtacttttattagagatggggttttgcctatgtttcccaggctggtctgaaactcctgggctcgagtagtctgcctgccttggcctcctgaagtgctgagattataggagtgagccactgcatccggccctaccactattttcaacataaattatgccatagtataaactgtaggaaacgcagactcattgggatgacttctaaggttcttcaccttccgtcattctgccacatcctttcctgtcaagtttgtttcttctaacccctataccttaattgtctgttctgggcaaggtgttttatttcagctactgtccctgtatgtgtttcttgggatgtttcctatgtgtgcccctgtagcttttcttaggatgttttttgccttcgatttcacttgccatattttttaatgcccgtcaaaactttaggcaaagccttttgtgtgagggtgagagagagagagagagagagagagagagtgtgtgtgtctgtgtgtgtgtgtgtgtgtgtgagagagagacacagggtcttactttgtcacccaggccggagtgcagtggtctgggctaactaaagtgatcctcctgcctcaaccgcctgagtagctgggacttcaggcgtgtgtgacaatgcctagctaattttgtttaatttttgtagagatggggcctccctgtgttacccaggctggtcttgaactaagctcaagcgatcctcccactttggtctcccaaagtactgggatcacagacatgagccaccacacctggactgcaaagcattcttcagaaagtgttctcttacagcatccatctgtttggttctgagtacatatatctatctatatctataggtagaaactgcttggtttgtcttctgatttccacttataaatgtgttgtactgttcagtcattttaatgtgtcttctgtttctttgattaggttgaatataggtttatgatctgcagggaacttgacatctttttgttgtattatacctttctttgtaactcatagtacagaattgtactcaagtattcagtaaattttcttgactacaccttttctaggaaaatacttaaatactcctgggcactattttgtttgttagaatctctagggaaggagattcagcaatgctactaactcctgagaaaggtaaactgttttgattctgatactctggttgaatctttgatcttgctttgctgacggaagataactgtttttgtataaattactccagagtatctagaaactctttctgggtagaattctactttgtagagtttagctagctgttagtgggtgctgggagcattcttaggtagaatattcaggtaagtggattttggcctctatgctatatctatctgcttcttcctttagaatgatccatgtcatgggaggtttttcagaatacccgtggatggatttaggcagccctcctttcattttgtcagcctattatttcctggtttttactcagtgaaagacttcagaagaaggcattttatattttaagttttcctttcatcttatctcctttgctaattccaaattctgggaagactgcattatccttagcatgtttgccattattattaggttgccaaatgttcaagaaagctgtaaaactaggccatttatgtgttgtacaaatataagttgtacagctcagctgggccttatttgccgctgaattatggtctgttcatccctaatttatttgcttttccactagtgcctattctaatccttttctgctgttcttaagcccctaacccttttattttatggcaataatgttacctcatacccattcaaaggattaaaaccatccaccaagagtcccctatcataagccccctcagaaattgctgtaaaaagcctctgctccattttttctcataacagtgtccaaaaagtcctgtacttgggccagacatggtggctcatgcctgtaatcccagcactttgggaggccgaggtgggcggatcatgaggtcaggagttcgagaccagcctggccaacatggtgaaaccccgtctctactaaaaatacaaaaattagctgggcgtggtggcgcatgcctgtaatcccaactactcaggaggctgaggcaggagaattgcttgaacccgggaggcggaagttgcagtaagctgagattgcgccactgcactcaagcctgggggaagagcgagactccgtcttgaaaaaaaaagaaaaaatcctgtacttgtacctactgttcctccctttccttcttttcctggcaccttgtttcattagttgtttcctctctatgttgcttcttcagatttttcttcttttttgaattattttccacagcttacaaatgttcttgggccttcctgagccttataaagccaaaaagtgaaaaacctttgattcttccttgattgtattgttctttaaaattgtcattctgtttttctctttcccttcatgactgggcttcttaagtcatctatacttgcctctgtttcctgactacctactccctgcttaaccattttttagcctggtttcatcttccctgtattcccttgaagaatgtaaaaatccagttttattttcagtttcaattttttttgtagtctaaggccctctggattagtgtgaaatctgatatttttctttatctgattctcattatttttgttgtattactattggtcaaacccccaatgaccacctagtttttttgtttttttgtgttttttttgaaactctcctcattttacatcaatgttttattctttctcctcttagctctctgatcccttcattaactattttccctgaccattaaaatgtagctattcctgcagcatctaaccttggctaccacctctatcaccgctcttccatcccagttcattcagtctcatggcttcaactcatcttttttcaggtatgtcatctgcaaccttcattttatgagctgtgttcttcattcctaacttcctgctagttgttgtcacttaagtaacataccatgcctcaaagttattgcactccaaactgagttaattattctcttctcaaacatgacctactttttatgtttcattattattttttttagacagagtctcgctctgttgctgaggctggagtgcagtggcgcgatctcggctcactgcaagctccgcctcctgggttcatgccattctcctgcctcagcctccctagtagctgggagtacaggcgcccgctgccatgcccggctaattttttgtatttttgagtagagacggggtttcaccacattagccagaatggtcttgatctcctgacctcgtgatccgcctgcctcggcctcccaaagtgctgggattacaggcgtgagccactgcacccagcctatgtttcatgatttaaaaaaaaaaatttcaacttttatttagattcaggggtacatgtgcaggtttgttatgtgagtatattgcatgatgctgatgccgaggtttgggtacaactggtcctgtcatccagatagcatagtacccaataggtgcctcattcccccctccccaactctagtagtccccagcatttattgttcttatctttatgtctttgtgtacccaatgtttagctctggcttataagtgagaacttgtggtatttggttttctgttcctgcattaatttgcttaggataatggcctccagctgcattcatgttgctggaaaggacatgattttattcttttttatggctgtgttgtatcccatggtgtatatgtaccatatttcctttaaccttccgttgatgggcacctaggttggtttgtgtctttgctgttacgaatagtgctgcagtgaatatacaagtgcatgtgtctttttggtagaatgatttgttttcctttgggtgtatacccagtaatgggattgctgggttgaatggtagttctgttttaagttatttgagaaatctccaaactgctttacaaagtcaccgaacaaatttacattcccaccagcagtgtataagcgttcccttttctctgcagcctccctggcatcttttattttttgactaaaaaaaaaaaacaacacatatataaaaattatatagcagtgttttgtagttctccttgtagagatctttgacttctttggttagatgtattcctgggtattttatttttttgtgtgtggctactgtaaatgggattgtgttcttgatttggctctcagctttaatgttattgatgtacagaaatgctgctgatttttttttttcttaaatagaaaaaaggtcttactacgttggccaggctggtctcaaactcctggcctcaagtgatcctttggcctcagcctcccaaagtgctgggcttacaagcatgaaccactgtgcctggctaactgatttttgtacattgattttgattagaacagtgttcagggtttacatcattgtaactaatcacaattgagccgtatcgtgtgaatttttttcctctctcattagctttctgttttccctggggttgataagtttgttttttcatttgtttagtttttatatgtgcttatcttcaaactctctcttgttaatttgctccttaaatgattcaaacttaccaggcattttataagtcttttcttggaaacaacatttttggaaggttctatcttgctccattctggtcggtaatggtaatactattcccagagtccagctgccatcctgaggtcttccttaccatcatcctagggattccttttgcttttcttttaaattggaacacttgtttttcagttttttttttttttttcgtcttctttcttggcttactttttcagcttggtggagaatctcctctagcttcctaagaaagaatctatgggaagtaaatttttaaggtgtctttattataatgtctaaagatgtctctgtttttcacttgctgatttgcttgagttccttatgaattctggatattagacctttgttggatgcatagtttaacaaggccaacaaaagcaatgcgggagaggactctctattcaataaatggtgctgggataactggctagccatatgcagaagaatgaaactagacctttaccttttaccacatgtaaaaattaaagatggattaaaaatttaaatatatgacctcaagctattaaaatcctagaagaaaacctaggaaatacccttcttgacatcagtcttggcaaataatttttggccaagtcctcaaaagcaattgctacaaaaacaaactttgacaagtggaacctaattaaatgaaagcttctgcacagcaaaagaaactatcaacagagtaaactgcctacagaatggtggcttctttcaatctggaaacttatccttcagttctggcatttccttgaattatttgatttcttcctattttctctttctggaatgcttgtgtttctggattaaaattttttttcctctccttccttctttttgtccatttgccctactttttgaaagatttctttagctttacttttctttccttctattgagttttaaatttctgctaccatatttttaagtattcattcttgtgtgattagttccttttaaatattattctgttcttgtttcatggatgcagtatcttttatctttttatgggcattagtaatagggttttttttgaagttttcatattccagtgtaatagatatttttctatttgttggttttggtttctgtttggattttagacatagatatatcttagctatctgatcctttgctatctgctcatatttaagaatacatcaccaacaagttgaatgggaattgtgaacttttaaattgtggttttcctatgggttatctgtttttatcatgaacaattttttttttttttttttagacagtcttggtgtgttgcccaggctggagtgctgtggcaccatctcggctcactgcaagatggtgaacttttgatgtcaaagtctttatatcttttgtcttgaactggttgggtgtccagagtaaaaattttcttttctcttttttctttttcttgcattttttttccctcccgagatggagtcttgctctgttgcccaggctggagtgcagtggcgtgatctcagctcaccacaacctctgccttttgggttcaagcagttctcctgcctcagcctcccaagtagctgggattacaggcacgcaccaccacacctggctcatttttgtgtttttagtagagacgggatttcaccatgttggccaggctggtcttgaacttctgaccttgtgatccacccttcttggcctcccaaagttctgggattacaggtgtgagccactgcgcccaatgccgcccccccccttttttttttttgagacagggtctcactctgtcacacaggctggagtgctggagtgcagtggtgtgattgcagctcactgcagcctcaacctcctaggctcaagtgatcctcccaccttagcctcctgaggagctgggactacaggtgtgcaccaccatgcctggctagaagaaattttaatctcctatttgtaggatatgactctggccagttctgagatgatatctgggcagagatctcaacatttagaaaaaagactttctcttaattttcctgttttcaggtgacccttctctcaactgtgttgggtatagaatagccttgtattctgccagagtagggacacaggccccctgggttgcagagtgaagggaggagatttcaatggacttttaaagattcctcttgacttagcttcacctttatcagaaggtactgggtgccagcacttcctgagtctttttgaaggacttaacttcacctttatcagaaggtactgggtgccagcacttcctgagtctttttggagttctgtggggtgattgggctgcttggatttctccactgcaggctcagaatttaatttctaggagtctgcctattacttgcctttctgctttctagacttgatgattttgttgctgctgtctctttctccattttccttcgccttgtggattatgccgagagaaaaattcctattactattgtttacctgagttttgggagagtttggaaatggtctgtgtctgttctctgttttctgaaacataatacctgagactgggtaatttataaagaaaaggggtttacttggctcatgattctgatggccggaaattccaggattgggaagctacacctgatgagggccttcggctgcttccactcatggtggaaaggggaggggaagtgggcgtgtgcaaagagatcatatgaaaagagaggattgaagatagcgaaacccaggaagccagactgttttcaacaacccgcactcttgagaactaatccattcccagggaactcaccccagtgggaaggcattagaaggcattcatctgtttatgagggatccacccccatgacccagacacctcctatcaagccctacttcccaacactgccacagtggggatccaatttcaacacgagtttgggtcaggataaataaaccatctccaaaccatagcagagctgtatgtgttctctgcatctttaacacctgaaccctatttctttcagcaacactattgtctgtactcgcctgtgcttgaaacttgggagtgatctttttgtttgtttgtttgtttttagagacggggtttcaccatgttgcccaggctggtcttgaactcctgggctcaagtggtccgcttgcctaagcctcccaaggtgctaggattacagacatgagccactgcaccctgccgggagtaatcagtcttttcacttaaaatgtatttattgaatacttagtgtgtgccagatactgtactaggtatttggattttaaaccctgaaaaagaaaaaagtatacttcctggctgttctgaactgttcagaataaagttggagagaacataagtgaacagatgaaccatgaaaatcataaacgtatgaagacagtgctctgagagcagataaggactctgttggggaagggttcacatacctgatactacaaccagattgaacttgttcttctttttcattgtctttgttttctcattttgtactttagcttatgctgatcccttggaataggctctaggccctggagtgttcccctgtctttttgatgttgaaattctctgtcttaagctggtataagataggctaatctcagggagtagagtgaggtgactacctcctgtacaaagtgttccctcaagccctcagcttgaatatagcctccccactgtgctataccttttcctttcaaatgacacctgacatattttgtgtttaagttatttatgtgcttgtcttacttcccttactggcctgtcaactcattgagggtagtatctgtatctgattcatttatatagtctcaaagtgactagcatagtgtttaataaatgtgttaaagatgataaacccttgctgtgtcacttcaagtcaaactaagacttcttcaaactcggacactttttaaaaagtcatcatttgacagggacaggattttgatttccgtattcatgtatgagtatcaaaatgtgattgtggctcacagagcactcgcagcaggggacagacactactgcactcttggtgagaactgcccatgtttgtggtggctttcccaccgtgctgttaagtcagtatcattggttggttcacactgatataatgacaggtagtaagcagaggtcctgcaaaatgatgttagataacagcatttcaaggtcaaattctcctgtaagtttttaccttttgagaggatgaaaactgtaaaattatgtcctgccccaaatggctctataactttttaagcattttgtagggtatcatgttgataagcatgtgcttttcaggctctgagatgaactgttttaaaatgtgagttctatttaaaaatttgccatttaaagcacgcagaggcctggggtgcacagggaccctggatacagtgtagcgacttgctcagaatgaaatgctggtattagtttatgtggtccctcaatatgtgggatttcaccactgcttggacagaagctgaagtcaggtccagaaacagatgcaatttagacatgtataatcaagttggattgtgctacttttatttttctttgtaaaattcaggcaatagttgctttttctttttgttttttaaaatttttttaaattgaaaacaaaacaaaacaaaacagatgaggtctcactgtgttgcccaggctggtcttgaactcctgggctcaagtgatcctcccaccttggcttcccaaagtgctgggattacaggtgtgaaccactgtacccagcctgattttcatattaatagggaaactgatttctcatatattctggataatgtaactgaaggttcaggcttttatgtttatttatttatttttctctttagtatcagggaaggctgttttagcacctgctgtctcttttgcattacccagattacctgcagttgttgcaagtagaaaagttttggttttggccatgtttcttagtatatataatacttctttttactcgagagatttgaaaatgtacctggccagaaaaattaggttttacctgggagttgtgctttggaagctgacttaaagcctgagcagcagctttctcccccaacccccatccttctccgtggccaacctttggtttgggcatgggcagtcattatcactctgtgaggctgagacactgctcatggcccagaggagtgaaggtggatcttcttgaaggcctttgtcttttgtgctattcaagtggtcctactagtgagcaaagtttacagtattttgtatctcattcctcaggatccagttagttttgtagccctatctggccctgccaagcacacaaagagtcttgcttgtccctgttttcagagacttccttatgtctctggatgctctgctaggtcacgacctaacttggactgggtcctgtgtagtcttcctgctgtgcatgtggtaggttcgtgaaacacacttcattcctggcacagcagagggcagcagtggcaagtcgtgagtctcttcatcttaccacctttcttccacttgtgtccttactgtcaacatgtaatttttagcttccacaccatgcaagactcttaactttttatttaattttatgttctgcattttgggcagtgcttctaattttttctttttaagaacgtaataatgaaactggagatcttaatttaaaagccttacaaaaagtcatgcataggtaaaaataattcatcaagtgaagtgaataagtttatgtggcatttaatttaggaaaaattctagaagtgtgattatagagtaaaacaaactttttcttttttattactttaattcaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttgtaagtactttaaaaagccaacttcagtctgatttaaagaaagttaaaacttctgttcatttttgcattttacaatgtttattcataaaaataaagtctagctgtgtgattttgggcagtcttcctaacctgtcatggttctttggaactgtgctccgtgagataaggatggccttgtaaggaaaggtctccatggttacaccgtttgggaaatatgttttgtattgctttcccctattaggcacactgtatgaactaacatattcagggccccaggaagtcctcttacacaatttatgccatcgaatccagtgttcctcaaatgtatttaaaacatagaatgctttcttcatcactccttttttttcttcaattttgattacattggtttaggtgatttttcaaagtgttttcttacacctacaattttatgatttgatgactctgacagaaatgctcatcaatgactgaacaagatagtgaaatttttataaagtaaatgaggaaaatatgaaaaaagtaaataagaaaattctttgcttttcttccccacatctaatagtagctggtatttgtggtattcagagtgccctcacatataatttcttttgatataagtattcaagaagcagcgggttacagtagccctatgataataatgaggcaactgaggttcagagcagccaaatgatttgtctaaagttacattgtgattaggagaaccagatcttctgatttatggctcacttacattctcatctaatagtgatttcaaaagacttgaatgagggatattactgttttaaagagcataattgaaatataaaatatggttatataagaactcactgagggatcatgtatatgattgttattgatttagtgctacaatccttggatgttggttgcttatgagtttgtacccctttagcaggaaactaagaggaaaaatacctccctttaagtttgttaaaatctataagaacagaaaagaaaccactgcataagcaagacttgaagattaaaacttttttattgtgataaaatgcatataatgtaaaagttgccattttaaccatctaaaaatgtgcatttcaatggcattacattcacaatgctgtgtagccattactactatatatttccaaaactttttcatcaccctaaacagaaactttgtaaccatgaagtaataactcctctttcccctctcttgctagacctttgtaatctctaatgtaatctgcgaatttgcctaggtatttcatataaatggaatcatataatatcggtccttttgtgtctgactcatttcattgagcatgttttcaaggttcattcatgttgtagcatgtatcagaactgtatttcttcttatggctgaataatattccattgtatgtatatatcacattttttctttgtttttttttttcttacaaaccagtgtttattttcacatacagccttgttgtaaccaatgtacagatcaaaactcaaaatattcctcttcagaaaactttgaaccttatcccctagccgacctataatggttgaatttctgtcaagtatatatttatgtatataatgggcttaattatttaagagaataactgagtgatttgtgtgatctgtgaaaaggaattggactatcatacttgggttgtatatcacatttttttcatccattcatctgttgatggacacttggtttgtttccaccttttggctactgtgaataatgctgcagcattggtgtacaagtatctatttgagccttgtgtgtttacctaggagtggaattactgggtcatatggtaattctttatttatttagttttctgaggaaccactagatttttccacagcagctgcaccgttttacattccactagcaatgtacaagggttccaatttctccacatccttgataaaacttgttattgttcatttttaaaattatagccatcctagtaggtgtgaagtggtttctccttgtggtttgatttgtgttttcccaattaccaatgatgttgaacaaaagataatttttgaaaagattttaagagacctgttctagtgagaggaagataattttatattgcatgaaatgccttgttttaaaaatctgtacagcagttccctgttttaccatgctaaaagaaagctacccaaaggtgttccttaactgcatgtagatcccgatttcttaccctttggtctctccttcctcctcctgttctttctttccaattcctatgtgagtctactcctattgttaggtcttttttcttttactattccataattgggacaactgcctattgtggaataggcaagtttgccaagtttcctcgatcactgtcagccactaattttttaaaaaatgacctatcttgggaagcattttaaatctgatttcctgccctgtgtttttggcctccggcgctacgctgcctaccatatgtgcatgcttgcagggactatgcattcactaaacatttttttttttttgagatggagtctcgctctttcgcccaggctggagtgcagtggcgctatctcggttcactgcaagctccgcctcctgggttcacgccattctcctgcctcagcctcccgagtagctgggactacaggcacctgccaccgcgcccggctaattttttgtatttttagtggagacggggtttcaccatgttagccaggatggtctcgatctcctgacctcgtgatccacctgccttggcctcgcaaagtgctgggattacaggcgtgagccaccgtgcctgggctactaaacattttaatagctcccactggaagcttttttgtttctttctaaggtctatgtcttgatcttaaatcagtatattgtatcaatacatgtagtaaataaaaatcatcttatttggcaaaaactttggaagagtatattcagcatttataaatcttaaaaattgaagaaactgcggctgggcgtggtggctcacaccggtaatcccagcactttgggaggccaaggtgggcggatcacctgaggtcaggagttcgagaccagcctgaccaacatggagaaaccccgtctctactaaaaataaaaaaattagctgggcgtggtggtgcatgcctataatcccagctacttgggaggctgaggcaggagaattgcttgaacccaggaggtggaggttgcagtgagctgagatcgccccaagctgagattacgctattgcactccagcctgggcaacaagagcagaagtctgtctcaaaaaaaaaaaaaaaaaattgaagaaacttggattacccaaagtagttttttggggttcaaaaacaggaaaatgattgactataatggagcaatttggtagttctagagagaaataaaaatgactgagctaattttattttagcaaacctctgctctatattattttgatcatcttcatttatgagtattcattttctcttttgaataaacaagcattagggagaactactctgtatgttaattgggccagtctattcatttattcacaaagcttttatttctctttaggctagcttgagagctcatctgtgatgaattttcctttatagaaaatatgttttaagatgagcagtatttttaaagtatatgtatattgatccatattttgtttatgactgtcaataattatgccagttatcagtaattgtcatatttttttcaggacttatatttgaaatgggaggatattagaatagcttatctcttaaagtattttaccttcataggtatctctatttatgttgacagctttttgacattcatactagtggcctattgggagaaatccacacgggccatcacagcaccatccagtactgtgacttctccccacaaaaccatttggcagtggttgctttgtcccagtactgtgtagaggtgagtagttgaatttattctgtgaagcctgggtttccagagatcaaaggatgacagagaatgggcagcttaaaccattaactgctgaggagccttgcttgagaaattatagagtattttctttatagcctaatgacctctaactttgggatattaaaccacatagccagctttattattttaacagtgattgcagacttgatttgacagtatgacagggaattcagcaagcatttgctgaatgcctaacatgtgccaggaactgggaaaacaatggaatgactgctggtcatgaaacatgacatctcttatccagtatagatatgtggcatttcttaaacagtgtaggcacagactcttttcttcttaaaaaaggtggtgagaaatgagtccagttcagatttcttagatcattgagtaggataagataggatgttcattgccaggcactaatgaataaaataactcatataaattacttttttatgattttgtacttacctgttaaattttatgttcagaatgtatacctagctggccctggaagaattccacccagtgaagtgctatattagttttttcataaagtagtgaattatttttttccttcaaagatggattagtgctttttttttttgttttttaatagaaatgggggtctcactgtgttgcccaggctggtcttgaactcttggcctcaagcaatactcccccagccttggcctcccaaaatgctgggattacaggtgtatcaccttgcctggccaaagatagattagtttttccaggctttcttagtcttcattccttaggttggttttaccaccaggtagtttgaaaccccttcagatcacagttccaagaagatgggtatgggccttttggaaaatagagaaattcactgggttcacaggctcctcatcaagggagccatgactactgcaagcacttcttcagtgttctctgcttatttagcaaattttagtgagtttgccagccttgcccattactgtgaaggtgttgggggagagttgctaagctatagcccttcaacatagaggcacaggtgagagtgagggcatgagatccataggcttctcctaattctaggtgcagcagtgcatgtgacactgaagaacttccctactgagactcttcccattgcacacagaggcagggagtgtgaaaaagctctagtcctgtatgaaacagcgggaagaagtagggtgctgtgggcagtgttttgttgggcagagactttgaattggaagtgttttgttttgtgttactttgtttttgagacagagtctctctctgtcacccaggctgcagtgtagtgttgtaatctcagctcactgcaacctccacctcccgggttcaagctattctcttgccttagctttctgagtagctgggattacaggtgcccaccagcatgcccggctaatttttttttgtatttttcatggagatagggtttcaccatgttggccagggtggtctcgaattcctgacctcaagtgatccacctgcctcagcctcccaaagtgctggggtttattgggttttagatctcctaggagatcttgaaccttatgtgtagatcctcaaagtaaatgtggagcgtttgttaggatttttagaaacagtactaagtagcaacccctctttcagcctttcttgtcacttctaaagtccttaccctctgccatccttagcaatctccaggaaacaatgaaagagtatcttccttcttgaaatgtagggactcagctctggaggctctgagtgacaaagaaatgatgggagagagatggggagaagaaagtgggaagagaggggaggattctcaagggagattttcagtttcttaggagagattttcagttgtggaaccactttcatttttggcccttagctctgtatgtcccagcttggactcttagagataaggcggagaaaatttcatataattagttcataaccacagaactcactgaatgaaaaccagtcactgggcctatgatgaggtacttgttttgtccatgctagttctgaaatgataaagtagttctgtaatttaaagtgtaatgagaggaactcagtcacatatggtacttcattagacttgaatatattagagtaatttacagcagaacccaggataaaataccaggctgctggtagacatggtaataagcatgaataacaagagaaatgtgtacatgttacaattattgtgttaatttattgtaggttttacagtcagttgaaatgaaggttagatgacagtattagtggaaaataatctgaatatggaagctgcttttgttcatcctattattttttggattgacttttttaaagtgataaaatatttgcatgattccaaagtcaaagttttataatgcgttatattcagagaagtcttgctttcatccctatcccttcgcctcgctctccctccttccctgcatatgtaaactattttctgtttttggcttaactgtccaatatttcttgcatatataagcagatatctatatgcatatatatccatacctgtatccttctatatgttcttgtacatatttttccatctcatataaaagatagtagtgtatagtatatagactcttctacactttgctttttttctgttaacaatatatcctagagatttgtcgtcatcaaggtgtttttctcattgtttttaatggctgcatgatattccattatgtgattaatgtagtttattcagttggttccctattgatgagtatttagtttcctagtattttgctataaaaaataatgatgcactaaataatcttctgcataagacattttgtagttttgatagtgtgtttctgagcaatattcattgaagtggtattgctggctcattcttgctattttcaatatttttgctctcttcaaaatgcttatgtatgtgatttcctatatgctgtgtttattctgtagttgtggaatacagactcacgttcaaaggtggctgattgcagaggacatttaagttgggttcatggtgtgatgttttctcctgatggatcatcatttttgacatcttctgatgaccagacaatcagggtgagaaatattgagattttcattttgaacatttcctgatggtgagctaaacctcctacaaactaagaaattgatgggtagcactgaggtaagcagaataggaaactagtactatattcctattcaccctggaaaagtgctgttatatggactgtaacagtctcattcattcgttacatgttcattgaggattaccatgggccaagtgctgtgggaacttcagtgattaaactgtattttggttaatttaaaatactgcatttgattcctcagaaaaatttttgacccttttctttaccttgaattcctacatccaattacttgccaattctgagagagtctaccttttcattttctattattatctctacctttccatttctgctgcccaagttcaggactttgttaactgttacttctcttgttgtattagtctctgccacaagtcttctttcttgcttttctgcatgcagcttctaagatatttttttttcatgtacaatgcagtcatgtcatttttgctcaaaaataagatagtggctcccttgtctaccaaagtaaatatatacttctgtttctgccattaagcttctccacagcatggccttattctgctccactctgtctcccagtttattcctacagggaaccaacactggactgctcacattttcccaaacactccgtagttccctgcttctgtgcttttccttaagtggtttcttatatttggaatgctctacttacctgtatctctgtttgttgaaatcctaaccattctataagtcccctcaagtcttctctatttggggagaatgcctgtctctcttaatgccatctaattctatgtcattttctagtggtgcttatcaaattttgacttgaatttaaatacagatatgatttactccttatttccaacactccactgcttctctggctcattgacgtatcttacattataagctctttgaggccaggaaccctggctggtccccacagcatcctaatacagcattatgtatgaattatagctaaaattcattcagtgcttactatattcaagacattatgcaaagtactatatatatatatatatatacatataaatttactaattctcacaatagtcccttttgcagatgaggaaacaggcagagaaagactgagaaaggtcattggttcttaacatgccagtctcaatgagcttgagccagaatataaatcaacacattgctttcttcatcaagaaagtcttcttgaaatgaaataagctgcatcactagacacagttacagtgtgtttagtgatgtagttgatttacgttctggtacaaacttctttttgtttttttgagacggagtctcgctctgtcgcccaggctggagtgcaatggcactatcttggctcactgcaacctccacctcccaggttcaagcaattctcctgtctcagcctcctgagtagctgggaccacaggtgcacaccaccatgcccagccaagttttgtatttttagtagaaatagggtttcaccatgttggtcagacgtcttgaactcctgacctcaggtgatctacccgccttggcctcccaaagtgctgggattacaggtgtgagcccctgcgcctggcccaaacttcttaccttgtggattggtatcaaacagtttgataaccagcaggaggtctttatctttgagtaacactgggttaagcaacctgcctgaagttacaactttaggtagaactagaattcatactgaggaattttggctctggagcccataactcttaatactaactgcatcttactatagattgtgttagtaaatatttatttttggattataatctaatattgaaacctttctagcatcataggtattttatgtgaaacatagtttgtctctcgctttaagatgaagacatgttattttagagatggaatgataatttctttatctcttaatcagctctgggagacaaagaaagtatgtaagaactctgctgtaatgttaaagcaagaagtagatgttgtgtttcaagaaaatgaagtgatggtccttgcagttgaccatataagacgtctgcaagtgagtattttttagaaaacaattggaaaattgttttggttgaattttctattcacggtttttcttgtttttggacttgagattaagcataattattttgtatctaacaggtgtccagcagacattagttaaataaatatatataagtcttgagctgaggctcagatatgcttatatttagaattaaattagataattcctcatctcactgctcttctgttgctatctatgatcacattctttgatttgcatggagtctaagaataccatgaggacaaactcatgttgtctacaagagtgattcagacatgtctgatggagtgtgcaagggggatgagcatatggaagcatttttaaaagggaaggattccagggtctttgaaagaacagaagtcactttaggtgaggaaggagtctgattgattggaactgaggtgaaaggagctgggctttacatactgaagtacacctgttcatttacacacacctttgttcagtaaatatttattgaatgcttattttggtccttgaggaggaaagggttgtatagtacaattgaaagaactgtattgcttagggatccaaacagcactactctagtctgttctccttctgccacccaacaaagagtgggacacgtgagaggaaggcatttctcaactagctgaagagagaaggagtcccaaagatccattggcagaggaatggtattcaggagctcggagtggtggtaacagatgccctaagagcagatgccctaaggagcactggaattcaagagcaggttggcatcactgtgctggtggctaaataaggtgtcgttgcattgacagagatgtcctggaagtggtgatagcgttgtagatagtggcagcaagagaaagcagatgcctcatggaagattaaaacacaagaggctatctatatgttggtcagcccaagcagaacagcagagtatggaccattgaaggaagtgtcagcatgtggagctgacagcatgtcactgtgacttgtggctgagagaggtggtaagagcaagcagccagataagaagggcaggaggtggcatggcttttatgtgaactggtgggacattctcccttgccctgaggattccctgagacataggattgagaaggacagaaaccctttcatagtgagggctaattttctttcttttgtttttcttttgagacagtttctctctgttgcctaggctggagtgcagtggcacgatcttggctcgctgcaacctccacctcctgggttcaagagattctcatgcctgagcctcctgagtagctgggactacatgtgtgctaccacgcatggctaatttttgtaattttagtagagacaggcttgtgccatgttggcctggctggtcttgaacacctgacctcaagtgatccacccacctcggcctcccaaagagctgggattataggtgtgagccaccgtgcccggcctaagggtttttttttttttttttttgtatttttagtagagatgaaactattttctcatagtatatttagggcctttcattagctcttgaagagcacgaatacagcttgagttaactttttccatatgggttttagaagtgctttattaacttctagggaaaggttttggcagtgataacatagtcttatgccatcttttcgtttgatttttcttgatttgcttattgaaagatagggagcatgaatgtgtgtgagagagtgaaatgagatagtgatgtcaagctagagaggagagagaggagcagaatagagaagacgagagtaatagagcacatgtgtggaaggtctgagaggaagcagacaattgagacagatggacagagggtaggacagagtttaatgagttgtcattcaaaaaatttttttttgtagagatgggggcatctcactatgttgaccacgctggtcttgaactcctggcctcaagtgctcctcctgcctcagcctcccagaatgctgggattacaggcaagagctgccatgccccactcaaaccttaacaagttgtaaagctgtagagctcagcttggtgtagtggagagaatagtgacttttcactaaggagacctaggtgtaagttcagacttctttatcaactagttctatgatgttgaataaattgtatcacgtctttgagcctcagtttgtaaaggtccttttcatctttacagtctctgagctagttacagggtcaaagtagaatccaaattcaggagtagatactgggagtaaatcgcctggtatgtggtaacttcttgtttactgtgggtgtcaaaatcaagctgtaagtcacctctgaatatggcttgctttgattttacaagttttactattgtcctcaatatgctgattaggagctcctaatgcacagtacttctggggtgaattgggatatggaattcaatgtgaatttctcattaactgttttttagaaagctgattcttccacttgggatatttctacttcagttttcttgacaaatttagtgtcctcatgcttgtatttcctttattaaatttgtgcaacctttctttaatgactgttgtaactgtgagacttaaaaagtcatctgtctataaaggtatcattctatgtcagtggttgtgggagagtttagaggataaacttaatagtttcatttaagtgaataaaacattttttagttactacttaaagaattcttgaaattgatttttgagagaagatgttcagctcttcgtagttcaattttcattttgaatatctaatagatcaaaatgtgctatgtaaaataatgttaaggaaaaactacctgtgattggttgactctgtaatctttgtactagaaacaaagatgcctgcctatttcatgttgaaaaataattcaagaattttagtttatgacactaagagagaggtatctgacaactgatttaagcttgagaaatattttcccaggtcacatgttttagatgagtgataaggcatcataattcatgggatttaagcattggtacagattatgaaattaggtaatctttgttcaagcattgtaaatccagctacacaaattatgcttatgagttcttctccattgtcctcactgccccagctccaagaaaaagaatcttaatttacactgttttgtgagtgatttggaggatataagccccattttaatttgtctttttatgtctgtctcagtcttgtttgaccaacagctttgaaatgtagcagaaaagtatattttaacaaatgatagccctattaaaagtgggctttgtgaagaaatggtgtggagctagctgtgggattacaaatcagatagatgtgtctcaggtggcgggcgcagcagctgctttttaaaccttgtaatgcttgttttattttatgaaaatgtatttgaaccaccaaagtggattgaaatgaaagtgtgaagtgctaaatgcagctgctaagactaggatatggcttgttgttcccctgagagctcttgttggttattttctgtgttttattttatttttttcaattgaagcctctgttctgacgaacaaaaactgctcttacagcctaataactgattttgcctcatttttcattagctcattaatggaagaacaggtcagattgattatctgactgaagctcaagttagctgctgttgcttaagtccacatcttcagtacattgcatttggagatgaaaatggagccattgaggtattcagtgctagtcttcagaatctttctgtacagaattaaataaaactaattatatgtctggcattgtgcacttctatttttatttatttttatttttgaaatggggtcttgctgtgtcacccacgctgagtacagtgacacgatcacagccgactgcagccttgaccttctgagctcaagtgattttcccacttaagcctcctgagtagctgggactaaaggtgtacgtcaccatgcccgactaattttttttttttgtagagatggggtcccctgtgttgcccaggctggtctcaaactcctgggtttaagcgattgtccggcctcagcctcccaaagtgtggggattataggcatgggagcttttgtgcctggctattgtataccttttttttttgaatcaggatctcaccttgttgcacaggctggagtgcagtggtacaatcttggctcactgcagcctttgcctcccaggctcaagcaatcctcccaccacagcctgctgagtaactgggacttcaggtatgcaccaccacacctagctaatttttctgtttttgtagagatggaggtttcaccagtgttgcccaggctggccttaaactcttgggctcaagtgatctacccatcttggcctcccagagtgttgggattacaggcatgagccaccacatccagcctattgtacacttttatactaaataaatctttctgtgatctattagtcattgttcgttaaactaacaatcatcttatccagttggctgtatatttttcagatttcctttattactgtttctcatgctttttgtctttttatgtcccttattctctacttagttgtttggctgttctccacatatatcaaatactatctatcaagatttcgctaactatgcaaagagcatttttttctcctcttcttagaagcccagccatgtggggtataagttgtttccatttcggtactgataaggctcatggggaatatgggtgcagggctgcctgtgcttgcctgttccaccaatccttgctgttctacttttggtggcagaagaacctcagttcaccacctgaaatccttaatttatctaacaagaccaaataggtaaaaatagaaacactttgcaaggcaaaaatgtagtataataaaaggcattttgggtaaaaatattgttgtctttatcacaagtgaaattcatcccaaaagcacattttctctagctttatagtggtttttcaaaaaccttggttccttctctcactttttctcaccaggtgtctgggaattattttttaaccaattacttatggcactggccacagttattttactttggattcattttcataaggaattacacaaatattctctagtccatatggccccacagagaagagactatatgcttagacacaaagtgaagaaggaagcatttacacagtgatctcaatactcttatatatttgtcatggcccttatgtcatggattgagagttcaggctttgttttctctttattattgtgaaaaatttatttatcatttgttaagatgtgtactattctgggataaagtacatcatggatatgtatttcttaagcaagggataattgtatgtttacaggtgaaccttaggcttccatctcaggctcatctctcaaactgttgtgtattattatttattcttaaagagtccttggtttcccttttctctttaccttgatgccaagtcagtaccacattcttttcatttttaccatctatcttaaaataagtcttttagatagtttaaaaataaactcacaacacacatatgtgcttcatccacatcgttagttccctcaaagtcatcaaataatataaataatacataatgaaccatgtgaaattaccagcatttacctataaagtggcagtttcatatggtgtagcctcatatcatcaaataatagcaactaccatttattaactgtttactgtgccagatgctctcattgaattcttataacatcctggatgttcgatgttgttattcttgttttaaagatgtctaaactcttatttccacaattttcataaaatcagtaagtggcagagctaggattcaaacccagatctctgaggctgtgtgctcaactgttatgctatcctgcccttgcctcagggtttgtgagatcgttcatcccgctcatttaggaaggtttccattcacacaattcccctttgttttcaaggggcttttcttccagacgtgggttaggtttgagtttctggtgtctcctgctttagcatcatctgtattttccttaggctttcttgagtacattttaatttggtcaatgaaacatatttcctctctttttgtttttttggtatgagttcatttgaaagcctttttttttctttttttttttttgacatagtcattatcttttgaatttgttactacttttatttagagtattattagtctttggccctcttaagtattctcattgcactgcccaccagccttctgatatcctgtctccctcatcatcttttatctttccttgtttgtgttgttttatgaataatttgccttctcatccaggacttacttactttcttctctcttatccatcttaaatgtctttttttttttttttggagggcaagcccagacagccacttgtttgatgaagtgggtagttgagtactcagaaggaccactggttcctactgctgtctgatgattgcagtgagtgttttattttagggtccaatatgtttgcatgtaggcatacatggtgtgcatatatatatatatatatatatatatatatatatatatatatatatgacattcatttgtttttaattaggctggaagcaccagatggaaattctgtaccctccagtctaattttagtttaatatctttggggtgtaatgcctatgtattgcttagtttcttcttaattttctgtgtttttctgctttgaagattttagaacttgtaaacaatagaatcttccagtccaggtttcagcacaagaaaactgtatggcacatccagttcacagccgatgagaagactcttatttcaagttctgatgatgctgaaattcaggtgagagggaggatgaactcttaacatatttaatgctgattctagcaaaggaacactatgattatgcctaaaatctggtgtatattttaaacacattacgttgggcatacattcagattatgtacatgggcttagatgaaacctatgggtgtttcatatttttctgtgggtgaggcagacagtttatcttagaatcctctgttggaaggttgtttattttgaaaatgaagggtttgtttgcattttcttgcctgtcttggtatttggatttgtatcagtaagtatactttttgccacatttatgtaatttctctttatttttctttacagtagtaaaatccaatggaaatcatttcattctttccttttaagaacaaaatgtttattacaggaatgaaattctgtgaaaagagaatggtttgacataataaagaattgtggatatggaggcctaaacttactatatattcttttaaaatttacttgattattaaagtcccaatgcacattcttttaaaattcaaatagtattacaagacttattatgaaaaacagaccctttcccccatttctcgttctccagaggcaccacttttagcttttagatgattcttttgatattaccttcatgcctctatatggcatgcttatagtgctcttcttgattttcccatttgagaagttatctaccgaattccctacaggaagatgttgcttttttccgccttccacctgtcctgccttcagcttatgtgcatgcacacgttcacagacactcatttatcaatccatttatcccaattataacgaaattttgtttagatccttcctgttactatgatcactgtgtactaagggtactgtgaatgcattttttgccttaacgcaatttaggaaaatttgacctttgggtgtagttggaaattattttacactaaaactttgaagacattgctccattttcttccaagttccaaagttcacgttgaaaagtctgaagccattttgctgcctaatctttctctctggaagattttaggatcttcattttatccccagaatcttgaaatttcctgatgatacactgtgttgttagtttttattcattgttttggatattcagtcttccttttcaatttggaaacctatgatttttaattcatggaagttgaattatttctttgattctttcctttttgttccagtttgctttctctttttgtaacacccattattcagatgttagatctcccggactgataatctagttttctttttccacatttcatctttctatagtgtgctttatgtttttttctttatttttttttgagatggagtctcactctgtcacccaggctggagtgcagtggcgcgatcttggctcactgtaacctctgcctcctgggttcaggcaattctcctggctcagcctcctgagtagctgggattacagccgtatgccaccatgccaagctaattttttgtattttttttagtagagatgagattccaccatgctggccaggctggtcttgaactcctgaccttgtgatccgcccgcctcggcctcccaaagtgctgggattacaggcatgagcccccgcacctggcctactgtgctctatttttggggagttttcctcagttttgccttccagccattttattgagtttttcatttctactagtatatttctaatgtgttaaattcttattttgtagatagaatattttatctctctgaggagatatacacacagacaggtaaatatatataatatatatatagaaattatatacacacacacacacatataatttttttttgtttttttttgagacggagtttcactcttgttgcctaggctggagtgcaatggtgcgaccttggcttgctgcaacctccgcctcctgggttcaagcgattctcctgcctcagcctcctgagtatctgggattgcaggcatgcacaaccacaccctgctaatttttgtatatttagtagagatggggtttcttcatgttggtcaggctggtcttgaactctggacctcaggtgatccacccaccttggcctcccaatgtgctgggattacaggcatgagccactgtgcctggcttatatatataattttttccccataaatttttgttttgctgcatagttgctgttccctccaagttgcttttttctgtttggttgttttgacctcctattttgaaggcctccttagctctcagtggtcattggctatcagagatctgtactgaacaactggctgaaagctctgtgtgttgactgagatcttctctaaaaggtgaatctgaaaggggaaactttgttgtgagtatcttcaggtcttttgtcttggtctcctcagattcctagagaggaattttctggtcttttgcctggaggataaacctggctggcaggttctcagagctaagttggggaagataacaggaagtattaatagatgttggatctcaacatttagtatgtacaccttcccttgatccctcattctcagaattgtaattctaccctcagttgtgctggtgcccttaaattcagagattcttctttctagtttgctgtcactgtctgtctactttcttcctttttttcccatagtaactttgggattcaacagcaattcttttcttttctttttctttcttttttttctttttgagacagtcttgctctattgcctaggccggagtgcagtggtgcaatctcggctcactgaaacctccacctccgaggttcaagtgattcttctgcttcagcctcctgagtagctgggattacaggcacctgccatcacatgcagctaatttttttgtatttttagtagagacaaggtttcacgatgttggccaggctggtcttgaactcctgatctcaagtgatctcaccttggcctcccaaagtgctgggattacaggtgtgagccaccgtgcccggccttcttttttatgtaaaatcaagtttcctaaactccttggaggagtggggaagtccagcatttctagcttcacagctctgcagctcgttctcttattttcacgaggcattaaaaatatggccttactgggcgcagcggctcacacctttaatcccagcactttgggagtctgaggtgggaggattgcttgaggcaggagttagagaccagcctgggcaacatagcgagaccccatctctgcaaaacaaaataatttagccaggtgtggtagtgcatgcctataatcccagctactcaggaggctgaggttggaggatcgcttgagcctaggaggtccaggctggagtgagctatgatcatgctaccgcactccagcctgggcaacagagcaagtccccatctcaaatatataatggccttgttcttaggagatctctttgccccatctccttccctctcagttatttcgaccttctctttcctttgatgcccttatcctcgttctactccattggattctattccctgtggtttctcctcactgtagggttgttctggttaattttgagagctcacaaggctcacactgctccagtccttccagactgtacctcacactcagtgtctcctgctcttctctagttgttccattgcacttttcggtgaacactgtgtggctatcttaggattctctgcctcctaattcttaatacttatattcttagccccaccctcatttcctcctttgggtatacttagtgccttccatttttgagcattttgggagttcataatgccgattttgttgctttagactttttcttttcttttcttttttttgagacagtcttgctctgttgccaggctggagtgcagtggcatgatcttggctcactgcagcctccgcctcctgggttcaagcaattcccctgcctcagcctcctgagtagctgggactacaggcccgtgccaccatttccggctaatttttttttttttttttagtagagttggggtttcaccatgttggccaggatggtctcgatctcttgaccttgtgatcctcccgcctcagcctcccaaagtgctgggattacaagcgtaagccaccacgcctggccacttttgactttttataatgcctttaggattctgttttcttgactttgctgagtcagttaccattctcttgctttccagcctcccacattttgttgctgttatctcctttctcattcttttgatcttgccattttagtagggctttagaagtgaaggatagaatgcatatgttcagtggaaattattatattcttttatttagtatatatattaattgtggtggcaatatttaattgtattgttaaaaacccttttgggaaaaagatcttttaatgttatgtctgtgtgagtcctaggaagcagtatgattgcaatgaaatttggctttagtacagaaacttacttgttataggctcccatgacactggtgttctagctgtaaaactcagtgtaatagtcacctttcttcctctccagatgtctttggaatgggtaaaactaaaaactacatctgatgaagttcttttgagacattgtatactatgtattctatcaaaagttaaattcataaggtttttatgaccagcttgacgatttcaggtattctcagctagggggaagaataatttctagagatatttttagaaaaggagttagattatatttagaaatatgagttaagtagttgtgtttcttcctctttttctgttctactcagaatactttttacatttacagtgttttaaatgtaacaaaactctatagatattttcgagaaatgactggttgggttttgttttcattttttaaggtttttgtaaatgattaagtggaggtttgttttaattatctttgtatccccaaagcctggaatccagtaagggttctgtaaatctttgctgagctgaagttattgccaaactttgaagaatcagctcacctgattatagcccttaggattgtgaacattgaggtctactttggtagtttttgatcctttaccttgaagtaaataaaggccaagtattacccatgcttacatgagccagtatataggactatgttagttcttgctggtatgaaaagtttccagccgggtgcggtggctcacgcctgtaatcccggcactttgggaggccgaggcgggcggatcacgaggtcaggagatcgagaccatcctggctaacacggtgaaaccccatctctactaaaaaatacaaaaaaattagccaggcgtggtgacaggcacctgtagtcccagctactcaggaggctgaggcaggagaatggcatgaatctgggaggcgaagcttgcagtgagctgagatcccgccactacactccagcctgggcgacagagcaagactctgtctcaaaaaaaaagaaaaaaaaaatttccttaacatttctacaatttaaattttattcatatagctgaaaaaaattctacaagtatatatacattgcaaaaatagtcaatgatagagacatccccaaactcaacttttgcatttgactaatggtggtggaagtttagtgatattaaggttattcaattagcacagtgtgtttccgtgcaacaacaacaacaacaacaaatcactcatcatcattgcctagtcagaaaccttctgtaacaaaagctgcaaaggctattcttaatctgccctcagtggttgtcaaattctttgttatatctgctccagaaggctgtctgagttcttgatgcagagggcagaagtaagatactaagttagaaatgaacattgaatcaggcaaagctagaataggcagtgtctgtaaactaggaggagctgttcagcatagccattgatcctccagtccagtgaagcccagaaagcgggaggagagagccaggagtttcctagtagaaatggaataaggtcttttatgcttagtcatatggggtgcccttcctctctggtatgatttgggaagccagaaatgcctccatttcttccccttcccccagcatatctcattgggttcttaaaatatgaaaattactaattcattctctttagaattactctcacttccagttcgtcttctaaagttctcttgcttgcatacaagaccccatgctcctgatatcctgcttctgtgaatgagcattctgaggcagaagatgagagatctgaaagccagggcttgttggggaggacgactgctaaatgtggtggaaaaagaagtaaaaaaaaggggaataagagatgtcatttattttaagattttgcctaggtctgattaaagatatttctgctgtttagcattggccaataaaaagctagactcagaatgttactcatgtgcatacctgtagttgtggctgctttttctttatctttttattcttttggagctggcctgttttcccatacctcagaattttagcttcatcaggcccacggggctgtttctttggataccttcccaaccttttttctcttctgtttcttctgcgtctcctatgctctagtcagatggactcatgagcaggtcccttttcacgtttccctgctcctatactttaactccaacatttattccctttgaagaacccttctcagtttgtgaatcacactttaaacccattcctcaagcctactttgaatgtgctatctccaaattttctctaaggaattactttttttgagtttcacagaacttttatctctatcattgtatcttctattgtaggactttttgggtttgttgttgtatttctcattttctttgctaaactcttaagtttctttatgctagatccttgtttgattcctatttgccttgcatataggtactaaatagacatttattaaataagttaatttgaagtcaagtattaataaagctctaaatacagttgcttttagtaattaagaaatgtcctttacatagacatagcataaaaataaacttctgtgtacctctgtgtctcagatacgtttgtatgcatattttgtgctagttactcatgttatttcattccccccacccctttccttatgtctgaggagctcctcctgaagctccacatgaaaaacaatgccttctcacttccgtcattttgaggattgcgatgggggatagctgagatatttgaagcttgggaactcttgtgttttggtttgaagctgctttgatcaactggccttcccaggccagcttcagtggggccaggatctgtagacttccccagcttgtaggttcagaaatctgtgactatgtaattaggataattttctcaggaaaatttaatcagatggtgagctcactggcatattgtgtgtttttttttttctatcttctggtataattaactgttctccaagcaactgaagaaaacaaattttatttaggaggaaaagtattttattttgcccctagtcaatttacataaccgcagcttctgtctgtaaaatgtggacaccacagtcttctctcttattcctctctgttttactgaaatgccatgtgagtaaaagactttagacaagagaatgtacactctctccacccctccaatgagataggatcgggggaggattataacagacttatttctttgatattcaggtatggaattggcaattggacaaatgtatctttctacgaggccatcaggaaacagtgaaagactttagactcttgaaaaattcaagactgctttcttggtcatttgatggaacagtgaaggtaatttaaagtataaatttgttttttgaaaaagtattctcatattgcaatgattatattgagacagtcaaaagccactgtgaggctaattacttacttaaaaatttttaatttttctcatgcttgttttctgttaattgcagtcacctacatctgctgtgtttaatgagcatttatactgttagtcacatttaaagtaaaggggtcagaacagccagtgtattaaaactcttgttttatagacctgtcttgtagctgattatgctttttaatataaaatgttcttaaaagtgtcaacctccaagtgttttttttttttttttaaggtatggaatattattactggaaataaagaaaaagactttgtctgtcaccagggtacagtactttcttgtgacatttctcacgatgctaccaagttttcatctacctctgctgacaagactgcaaaggtaggtcaatcaattgaaaccatgcataaaactttggtagtggttatgtataatgagttcaaataatatatgcaaaaggacataacagttgctctctacatgtctgtttcatattttgtgatcttttggaggatgcccattggcatttagttggtatcaaatgaatgaaatgaaatacattgaggacttctgatttctcccttatggattactttttgtctataactaatcaaatgcaacctctactgcatattgtaggcaataaaaatcattgaaaagcatttacatttaattatacactgacaatacaattttaatataattaatgtaatataattgacgtgtgtctaaaatcacattctggtgaatgatgctgcttggtgggggacctcaagtactctcttctctccttttttctccttctaccagtctttccaaactataaaccttggaattgtcagggctgtatcctgtcttttgtgctctgttgatgactctttagtgcatcttagagttatcttctcctctttgtcaccaccctgaagagcatgctttcctcctcctccactggtgaactgtcccagcatcctgcctctggtctgcacctcttccactttatcttccataccactgcctgtgtcccttgttgaaacacctattacctaacggtttataggccaaccacttagctcctcaccatctttttctgctatattgtttcctctgtgccagcctactttccaacttcatctttttgtgcatgctgctaactttggtttgataaaccttctactcttttaccttgaagcattatgactcatctttctagacctagatttgatggcagctcttctgaagcgtttcctgaccctcaagcaaggttagctgctctacctccagtgtttctattacattttattcatttgttagaacatttacttcatacaactgttcactaactgttcgtgagcctgtctttgtgattaaactataaacttttcaaggatagtgactgtagctagtttatcttcttgtaccactagttcttagctcacagcgcttggaacttggtagttttcagtatgtggttgctaaatgatgttgacaaaaccatgagacaatattgaaagaaaaaaaaaatagcatttggctgccaagaagtaggctagtatagtgactaacatttaaagattacttgtcacatgctagtaatttcactctctataatctcatttaatcttcacatcataggtacaattgtcctcattttacagatgccgtgtctgaagctatagaagcttatatgagttgtcctagtcacaagaatctagtgaacagtggagctagcactcacattcaggtctgcttcactccacagactgctcttagctgattcagtgttcttctgtctaggtctaaattaaggaaggagtgacattgatccttgagctgaatttaacttgagtaaataaagggaaactcagaaaaattaacaaggttgcatgctggaacttgggcatctcatgacagtttatgaattgccagatattagaatgtccatgtgattgaatttatggctgaatagcaatcaaggcagatgcttattttgagtgtttatagcattgctaaacaatcctaattgccttccagatctggagttttgatctccttttgccacttcatgaattgaggggccacaacggctgtgtgcgctgctctgccttctctgtggacagtaccctgctggcaacgggagatgacaatggagaaatcagggtaggctgtttgctgacatgagagcactgctcttcttgtagcttgggctagcactgttcacagtggggacctttgttcacgggccagggaagcatagtcctgaagttgtggttggatgaggcattctttttgtttcttgtgcacattgtattcacagctgcactccactgcagaaacggattcattttagagttagagtgaagcattccctgtatatgtgaggaagcaagtgctctagtcatttgtagttcattctctgccattagcttgagaatgattcatcttaattcttggacttgaaccaaaggtttttggtagcagaatttgaggaaaataattttgtaaattatggtctggattataaatgaattgcaaattctgctttttctgtgctgaaagaaaagatctctttagcactatacccatttgatagccatttccagtgtggtttgttgcagtcctctgtggactgcctgcctgttaaacagtgcagaggttcacatttccgtcattgtggggcagcgaagggctcctaattgagtcacagtctgcatgctaggccagtttttattaccctgcagtgcttaagatatacatacaaaccatgccaattttatttagaaaacaatctattttttttagatatataattttgacttttagaaaacaatctttttaggaggcttagaatgttgttctctgtgtctgtggaaatatagtaccatatggaaagaattgcatgctgaaagattagaaattatggaaaaggagtcagttgacctagttgtgtcagaagaattggggagccgattggaaaagtttgggtattgggatgactactttggtaaccagtgtagatgaggaagatggggttttccccctttcattacaaaggaggatctaaaactccaggaacaggtatatagtgcagaagactaggagagtatacagtttgcaggaacagaggtgttatcagatgggctttccagggaaattaagattcttcttcttgaggactaagtaaccaaccttctctctaccagtcacataaatgtgtgtcagctgaagtggcagggctgctttggaaatgttcattttgctctgagttcgcgtctttggatgaaagtgctcctttcccagttatgaggcggtgtttcatttttcaaccactgcaggaaaaagttgtctccattaaaattgtgttattttaaaaatttttgttggtacattaaaaaaatttttttctccctgattattcagaatataggaaagttactgatttttgtttgtatatgtactaccttactgaactgtttctaatgagtttttccattcggttctcttggattttctagggagagatttacaaatgattgtttaattttcttttaccatttatgcctctgtttctttttcttattctggtgtacctttatttgaaaaattagagcactgcttatatattaaatgccactggaaataaatggcaatattagtatctgtgttagggttgtttataataaagtctagtaaaataattttagaatacatatatatggacatatatatgttttaaaaccagagaagcttctggataactctgttaatgaattgtgtatcatgtttatgtagatatggaatgtctcaaacggtgagcttcttcatttgtgtgctccgctttcagaagaaggagctgctacccatggaggctgggtgactgacctttgcttttctccagatggcaaaatgcttatctctgctggaggatatattaaggtaagagttccccaagaactgtgaaagaaaataatagcctatatcatactttccaagctattttcacttcctgtttctcagttgggccttttacaacccagcagagtaaaaaggctgctactccggaggctaaggtgggaggatcgctggagtctgtgaggtcaaggctgctttgagccatgcttgcgccacttcactccaccctgggtgacagagcgacatcctgtctcaaaaaaaaaaaaaaaaatctggcagtaaaatgagtttagtaactaaagaaaagaacagaaaaaaatattgaaaacaaaaaagaaccagaaaaaactttaaaaaataattaaaagccaggcacggtggctcacgcctgtaatcctagcactttgggaggccaaggtgggcggatcacctgaggtcaggagtttgagaccagcctggccaacatggcgaaaccctgtctctactaaaaatacaaaaaatagccgggcgtggtggcatatgcctgtaatcccagctacttgggaggctgaggcaggagaatcgcttgaacccgggaggtgaaggttgcagtgagccgagatcacaccattgcactgcagcctaggcaacaagagcaaaactctgtctcaaaaaagaaaataaataaataaataaattaattaattaattaattaaaaaaataaataaaaaggaaaagaaaaaaaaaggcagttactattatccccattttgtagtgatgaaactgagatccacaagactgctttcctcagatcttggggaagctttggtgacagtggcagggatgccctcaatccagagctgtcatactgcctcatactaaacttggggcattagaatgactagcaagttgggtgtttaacttagttctgttttccatgtcattcacaattaactatgttggttgaaaatctttaaaaaaacatatttttgaaatttcttcagtaataataatagcagcagtatatggctttatagtttacaaaacgcttcactcccctcatcttactagccagctttttgaggcttaaatttcattcttggtttacagatgaggaaaatgattttctatggaggttataactttcctaaagttacataattagtgccgggtgtggtgactcacacctgtaatcccagcactttgggaggccaaggcgggcagatcacttgaggtcagaagttgaagaccagcctggccaacatggcaaaacgccatctctgctaaaaaatacaaaaattagctgggttttgtggcgggcacctgtagtcccagctacttgggaggctgagaggtgagactcacttgaaccccgggggagcagaagttgcagtcagctaaggtcacaccactgtactccagcctgggcaacagagcgagactatctcaaaaacaaacaaacaaaaaaaccaaaaataaagttacataattagtaaatagaaaagccaggactcaaacccaggtctctgcctctgctttctctagctaattggctttttaaaacttactagtgattgaggccgcaatttgaatgtgttgtggtgcttcagggtcatatttttggtgtttttttgatgtatcttttatctatccactcaaaaagactgtgttgaatgtccagtgtgtgctaagctactgctctgtggcacaatgtttatggcttggttcctgcctttcagcagcttacagtctatgggggaagcaggtggtaaaccaataaagtccctaaagtttagaaggggtctgggacatgctttcatgagggaggtggaagcacaaaggagaggagtgaccagaccaacctcagagagttagcagaggcttcacctggaggggaatgcttgaagtgagtcttttgaatagcagtttacttgtaaaagtggtagaagatgatactctatatcagcggtccccagcctttttggcactagggactggtttccttggaagacaatttttccacagatggggtggtggtaggaagtggggagcggggaatggtttcaggattaaactgttccacctcagatcatcagcattagattctcgtaaggagtgcacaagctagatccctcgcatgtgcagttcacagcagggctcttgctcctgtgagaaactaatgccaccactgatctctcaggagacaaagctcaggtggtaatgttcactcaccagccgctcaccttctgctctgcggatgggttcctaaaaggccacagaccagtaccggtccatggcccagggactggggactcctctatattgggctgatcacttggacattctgaaagctttttcattcaaaattgattcctaataagatcttatgatactgttatttcttactgaaaacattcaagtgtaggagatgattctcattaattgtctaaggcaggataagtgtttggaaatatttgaatgactggtgttttggttacatgagacccacacagctgcaattttaccaccataagaatctagcttataaaaaagataaattagaggacagtttttagctttatgaaaggatgtactaaggggtacaaaaatacagataaacaaaaggagtaatttctagtatttgataatacagtagggaaattatagttaacaatttattgtatatttcaaaatagctagaagaattataatgttcccaacacaaagaaaagataaatatttgaggtggatatcccaattatcctaatttgatcattacacattgtatcacatgtacccccaaaatatgtacaacttaattatcaataaaaatttttttaaaaaagaaaggatgtatgttatccctttacaaggtttcattgaaaacacaattctgtttacaaaatgttgcattaacctacatctttattcagttattaggagatcctgagaaatgaccaccaattgttctcctttagtgtaaagataaactagaactcagtctgctctggggatgatgcttagaggagagtcattgctgtctgtgttggaagctggggagtcttcggctatattagctgctgacaaatttaactgctcagctttgacaccaagtttctagagaccacatcatttgattctctggcctccacagaattccatcacataattgagagtctggtttataagatgttacaaagatcagtgaccatatttgcagagttcttggggaaccttgaaataaagcagcagaataggtttacatagtatagatgttatgtctgaagggtgaaagaacttctagcctatgtatttagtttgtatatttaaatgacaatcaggctgcctttgccttctggtttgattactagcttattcaactgattatgatatagcccagcctgcatctacccagcatgttaatgagactatccaaaagcacagagcaaattaaaagtaaaaaggaacagctgctgtagtgtccaagaaaataggccttttgagcctgtttactttagaatccaagctgtataaattgagtgccagtaagataaagtaggtatccagaagcttaaaaagttcttaacttccaaattattcctatttataagtgaaaaaataatttagctgtttacctgcattatgccacagagtacatactgaatgacaagaaattcacattaattcatgtgcatgaagggaaagctgatctgaagtatggaatacatggtgataaatggtggtgtgccatgacttggtggcagcagagtgtaatggtcaggagagtgggcttttggccttgagataggctgcctgagttcaaagcctgcctctgccactcattagctttgtgaccttgcacaagattgtttaacttctgtgccttgattttcttatctgtaaattgatgtaatgataatacctaactcatttcacagatttcccatatacccctttcccccacaaacacatagcctcttccattatgaacatccccccaccagagatgtgcatttgttacaattgatggatccacattgacacatcattatcacccacagtccgtaattagggtttgttcttggtgctgtacatttttcgggtagttgaactaagtgatctctaagagccttagtgactgaaaacaaatgaatctcaggttggtggaatgtgcttgattacactgttattttacaaagcaaacttgtgagttctggaaaatcccaagttagtgcatgctggttcagtgaggtttaccaaagtccattgggtatacttttagcagttactattactaatagtgaacatgcttacttgacccactcacatgggaaagacaaaatgctaggtactgccataggcacaaaggtgggtgacactattactgtgttcataatactcaggatcatggtgagcttgaggccttttcagaataagtttacatgtattgtctcttgcccccattttagctgtgagattcatgggtaaactttatgattcccatttgttaaatgaatataaatattataagcaaattcagtgattgggaaggaaaggaaggacttggctacagcccttgctacgtttgagatgttcagtatttgtttagtaaataaataatatagattattttataaagaaacttggtcaagggctcttgcatcacacctggggaaagggaagattcagtagagagaacattgtttcctgtagcccatattatgaatagtttgggtctctgtcagaataccagtctgtgtctgcaaaggggcatttgagtgaagagagggggaatcttctgcccattctcccgagaaggacatgcagacaagagagttgagtctggccactgctgtaatggactctatagcttcctgtctgcagctctcaagcaggctgcatgtttctccagcacaactcaacggttggagttgggtgtaggcggagcagtgaggccatcaccagtgttcatcaggaagaggctgaccaggttgaatagtatattcagcattaaatccgagacattttcctcctgtttgcttgagttcggttggggggaggagatagggtaaaggatctgctggcactataaattgtcacacagtgtaattaccaatctaatgagaattttatttttctctgaacagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaaca

SEQ ID NO: 2 - DNA, 36447 bp, Homo sapiens
agggcagcggatcccatgtcggccctgaggcgctcgggctacggccccagtgacggtccgtcctacggccgctactacgggcctgggggtggagatgtgccggtacacccacctccacccttatatcctcttcgccctgaacctccccagcctcccatttcctggcgggtgcgcgggggcggcccggcggagaccacctggctgggagaaggcggaggaggcgatggctactatccctcgggaggcgcctggccagagcctggtcgagccggaggaagccaccaggtaagctttgcaccctctgtccttgcggggaggtgagggcccttggggctggggttcgtaaaggatcgggtttcatacttgttttccttatgtggaggagggtgtgttgcggggggtgttggagagaccgagactaagatcagaggttggggggacatgcttgtgttccctttgcccctccttttctgcttcgaccccaaaaaatatgtttattaccatttaaaaaagaaagatcctgcgcggacttactaagcttagcagcaggctgcagatctctctcctgggagcggtgctgggtaggggtggcacggatctactgctccagctctagcaatttatcctgcgtggctggcaggccggctctcccggggaagggaagtggctgcagcccccgatgccgctcagggaccctcccgaggggaaggaacctttgcgaggaggagggatctgggcatttagctgtttgcccctaatgccttgcctgagatcgaatcatgaataatcagtgttgtaaagtacctttacgcggattgactgatttaattttcacggcgactgcaaggtaaaatggcattacagcggcccttttttttgttttcgaataaggaaccggggctctgcgaggttaactcacttgcctaatacacttggacctgcaacattttattctccgttttcctgccggacatatacttctgctttgttaatacagtcttctgggtagtgggttgtcgttctgcggtggcagcatacctctctgttcgttcaagaattatcctcatttgttgaaaatgtaatagtgaaattctcgtacattgctggtggggatgtaaaatggtggaaaatagtttggtagttcctcaaaacattaagcattagaattagtctatgacccagcaagcccactcctggctatatacccaagaaaactgataacgtatgttcacataaagcttgtccgcccatgttcatagcatcattattcataatcgccaaaaagtagaaatgtcgttttttttgttttttttttttttgagttggagtctcgctctgttgcccaggctggagtgcagtggtgccatctcggctcactgcaacctccgcctcccggtttaagcgattctcctgcctcagcctctcgagtagctaggattacaggcgccggccatcacacccggctaatttttgtatttttagtacagacggggtttcgccatgttggccaggatggtcttgaactcctgacctcaagtgatccccctttcccctgcccctcggcctcccgaagtgttgggattacaggcgtgagccactgcgctcggccccaaatgtcattttattatttgagttataaagtgagtgaacctcttggagccctggttctttattcgaatacaggaatgttgtaaggacataacgactgatgcatcgataaacaaaatatggtgttaatatattcattcaatggagtattatttggccttagaaaggaatgaactgctgatgcatgctacaatatgaatgaaccttgaaaacatcacactacgtgagctaagtcagtcagaaagactgcatattgtgtgattccatttatatgaaatggccagagtaggtaaatctagagacagaaagcttaatggttgccagaggttgggggactggcggtgtaggtgagaatattctttttgggataatgaaatgttctaaaatcagggcctggtgagatggctcacacctgtaatcccagcactttgagttgccgaggctggaggattgcttgagtccaggagttcgagaccagcctgggcaacatagtaagaccttgtctctaaaaataaaaaaataaaaaacaaaaaataagaaatgttctaaaatcagtggtgatggttgcacaactctgaatatactaaaaactactgaattgtacattttaaaagggtagagtttatagtatgttgattatatcacagtgtaaacaattgtatgagaaaaacatggagcagtgataaattattttttatttttattttttatttttgggacacagtcttgctctgtcgcccaggctggaatgcagtggcgcaatctcagctcactgcaacctctgcctcccggggtcaaagtctcctgcttcagccttcctagtagctgggattacaggcgcctgccaccatgcccaactaaattttgtattttaagtagagacggggttttgtcgtgtgggccaggttggtcttgaactcctgatctcagggtatcctcctgcctcggcctccaaaagtgctgggattacaggtgtgagccacagtgcccggccaagattaattataaattaaagaaagatccagctgggtgtggtgacatgcctgtaatcccagcactttgggagtccaaggaaggcggatcacctgaggtcaggagttcgagaccagcctggcccacatggcaaaaccccgtctctactaaaaatacaaaaattagctgggcatggtggcgggcgcctgtaatcccagctattcgagaggctgaggcaggagaatcgcttgaacccaggaggcggaggttgcagtgagctgagatcacaccattccactctagcctgggagacaagagcgaaactccatctcaaaaaaaaaaataaagaaagaaagatccatattttctcagcctaaatctggaatacataggtcatgggactatagaatggtgaaatgcttggccaaattagaccaaaaatcagttgaagtggggaaagaggagaggacctctaaactgatgactgacttttgctgggcctgctgtattatcaaaaccaaagtctgttttctggcatagagttagggagggttggatagactaaagaagttaagattttagcattgtgtaaggggttgtcaggtgtggtttgagtacatttgtgcccacagggtgggtgatggtgctgaagtagttggagataaaggtggaaatgtgtaatgggcatttgtaaaccattttaatagtttgtactatctttcagattgatgattctgaaactttaaaagtataggatggtaatttttctgcagcaatagaaaactcataccaaagatatgtatgttggccgggcgtggtggctcacgcctgtaaacccagcactttgggaggctgaggcaggtggatcacctgaggtcaggagttcgagaccagcctggtcaacatggcgaaaccccacctccactaaaaacacaaaaattagccaggcatggtggcgcatgcctgtaatcccagctactaggggcactgaggcaggaggatcatttgaacccgggaggcagaagttgcagtgagccgagatcatgccactgcaccccagcctgggcagcaaagcgagactccgtctcaaaaaaaaaaaaaaaaaaaaaaaaaagatatgcatgttgtcacagatgttgcaatgttttttccagatttgttattttgacttttttttatgttttgcatttttatagtatacatctgtcaaattaaaaaaacaaacagtataggaaccttttataaccttgctactcaaaaagtgtggtccatggactagaagcctcggtgtcacttgtgaggttgatagaaatgcaaaatctctcctcttccagacttactgctgcaatttattaagatccccaggtgattcatatgcacattaatatttcagaagcattgctctatagaactgattatatttagatgatgtactgaactacaacacagacttgactatattaacacatttaagtatggcagggaaaaaattagaaatctatcactatttttttttttttttttgagaccgagtttcactctgttacccaggctggagtgcggtggcctgatctcggctcaccgcaagctccgcctcttgggttcacgcccttctcctgcctcagcctcccgagtagctgggattacaggcacccgccaccacgcccggccaatttttttgtatttttagtagagacggagtttcaccgtgtcagccaggatggtatcgatctcctgacctcgtgatccgcccgccttggctgggattacaggcgtgagccaccgcgcccagcctttttttttttaaatttttttttgagacggagttttgctctttttgcccaggctggagcgcaatggcgccatcttggctcactgcaacctccacctcccaggttcaagcgatttactgcctcaggctcccaagtagctgggattacaggcacccgccaccatgcccgactacttttgtatttttggtacccggccactccctatgtttttttagagtaaaactttaggctgggtgcggtgtctcacgcctgtaatcccagcactttgggaggctgaggcaggcagatcatctgaggtcaggagtttgagaccagcctggccaacgtggtgaaaccccgtctctactaaaaatacaaaaattagccaggtgtggtggctcacacctgtaatcccagctacttgggaggctgaggcaggagaaccacttgaacctgggagatggaggttgtagtgagccgagatcacaccactgcactccagcctgggcaacagagcaagaccttgtcccagaaaaagaaaaacaaaaattagccgggcgtggtggcgggcgcctgtaattgcagctagtctgagaattgctcaaaccagggaggcggtggtcgcagtgaccgagatcatgccacgaactccagcctgggctgcctagcgagactatctcaaaaaaaaaaaaaaaaaaaaaaaaaaaaaaggaagtaagggaaaagagttagagttgagaaaccttttgagctaaagggagaaaagtaacaagtttggagttggagcagaggggcattgacagctattggtctcctttcgtggtggagtaggaagctaggtcatcttacagtaagggaagtagaatgggatgctctgcaaaatttatgtggtaaatgtttgaaccagatgctggggcaagagggacaacacagagaagcatttggaagagatccaaatgagtttgaaaagttaaaaaattatgatggtcagtataggagcataaggtgatttgttagtgattatgaaccatatagctatacaaataacttatgtactttactaataatttttgtccaattcttatgaaaaatataagcaaatctgtaaatggaatttatgtagtacgagtgctactgattcctctgctgttagatttgcttggactggggtttcagtttgggggaatgttggtaagtcattttggaaaatgtaatcacatatccactttaaaggaattgactccagtcttcagctgggattatttatttctcagaagaaaggaaataaattagttatcttgcataattttaatcaaattttctttggcatagaactttaattcacattattgtggcttgtgaaaacattttattacctttgttttagtttgtatttcattcaacaaataaaaagtttggaaagagttaggcacatgataaaattggtaacttagtttatagaatagagttcagcttcagccagtttcctgtgaaaccaaatgctatttcatagaattagtgtcatgttgggagggccatgagctacagactttcactgttactagggatatttttagatttgtcccattttgtccaaaaggaggaaaaaaaagacaaagacattatttttttccttaagacaataaaattatactttttagtgcttcattgaggacattctttttttcattaaaaaaattatggcataatttacaaaaagtaaatttcactgtctttagggtatagttctgtgagttttgataaatacatacaattacataaccaccaccaccaccaccaccacaactgagctatacatactgacccatctttttttttttttttttttttttttttagacagagtctctctttgtcgcccaggctggagtgcagtggcgaaatctcggctcactgcaagctccgcctcccgggttcatgccattctcccacttcagcctcctgagtagctgggaccacaggcgtccgccagcaggcctggctaatttttttttgtatttttagtagagatggggtttcaccatgttagccaggatggtctcgatctcctgaccttgtgatccacctgcctcagcctcccacagttctgggattacaggcatgagccactgtgcctggccacctttaagcttttgcaagtgtaatcaaccaggtaagggtggtaagggctatttcccagaacttctcctgccgactcaaaagttagattcttctgagtaaaacaggctcttcactgttttcaaggttattccagtttccctgtattcttctatttaatctcagctgccacaatcagacagacggaaagcataaggacacttttttccttgcatctgtactggaaaccttagcagcagatagcagtcattctttttgatgcttaaatgataccatattatgtcaatgggagtccctttttcttggcttctgattcctttggacataatctattgattttttttttctttttctttttgtggagaacaggttctcactgtattccccagggaggtctcaaactcctgggctcaagctatcctcccgcctctgcctccctaagtgctgggattacaggcgtgagctaccgtgcctggcatgacccattgatttttgatagcttccttgatttctggtacaacaagatgtctcaggctttgtatatattttgtcccaagacacataatcagccattccttaagaacttgattgtatttttctcccaagtggagaattacatttagaaaccgttaagtcaggatctgagcaggaaaacagaaaccacactagttagaatttgatttaggaaattagctaaacaggttattggagttatgaaaagggaaaaagagaacacagaagtaacagaaaatagtaagtggaggaagcagctacaattcctggggctggggaataaagggaagaggttggagtgattatagccaggaaacttggaagaatggccgggcgcagtggctcacgcttgtaatcctagcactttgggaggctgaggcaggtggattgcttgagcccaggagttcaagaccagcctgggcaacatggcaaaatcctgtctctacaaaaaatacaaaaattagccaaatgtggtggtgggcccctgtattcctagctactcaggaggctgaggtgggaggatcacctgagcccaggtggccgagggtgtggtgagctgtgattgtgccactgcactccagtctgggtgacggagtgagaccctgtctcaaataaaataaaataaaataaaataaaataaaataaaaatataaaaagaacctggaaacttggaagagtggccaggaggtggcgcctcctacctggtgcagatacctctgaggacgttcgggtcggagagtgttgttgactgactgctgcgtacaggttgaatggcattgcggtgttgacactgacagaaacagcagacaggaagaagcaagtccactgtctcctcctctagcctagcatagtgtgttggcagaaccagaaagcaagcaagctggggagggagaaaggtttgtagacttccagccttacatcacagagccaagtatagaatgctgtgcttgcggccgggcgcagtggctcacgcctataatcccagcgctttgggaggctgaggtgggcagatcacgaggtcaggagatcgagaccatcctggccaacatggtgaaaccctgtctctactaaaaatacaaaaattagctgggcgttgtggcgcatgcctgtaatcccagctactcgggaggctgaggcgggagaatggtttgaacctgggaggtggagattgcattgagccgagatcgcaccactgcattccagccagggcaacaagagtgagactctgtctcaaaaaaaaaaaaaaaaatagaatgctgtgtttggacctgaggggcaaggggcaataccttaatacttggtacagaaattacagttgggtgcctggcatatatactaattgttattgtgttgtcattgtgtctagacctttccaaagggcagaattataaaataagtattttaaaatagaaaaataaatgagttcatatttatattaattcaaatttaacattataggaattttaacttctttgtatattttatatgaaaaaaatcttgattcctaacttaattacaaatatttgcacaatctaacaataatgtataaaataagttcaaaataatgccaggttccagttctggcatgacagcatgaagaattctgtggacctagtccccagtgaaactggtgaacattaattttaaaaaacaacaaattacagtttctggaaatggtcctagggaatatagcaaatgaagaaacacctttttttttagacagagtctcgctctgtcacccaggctggagtacaatggcgccatcttggcgatctcggcttactgcaacctccacctcccaggttcaagcgattctcttgcctcagcctcctgagtggctggggtttcaggtatgtgtcaccacacccagctaatttttgtatttttagtagagacagggtttcaccatgttggtcaggttggtcttgaactcctgacctcgtgatccacctgccttggcctcccagagttctgggattataggtgtgagccaccgcgcctggccatgaagaaacacttgttcaagaaaatctacaaaagtcagtaagaacattgggtctgtggtatttgaactaaaagctcctccatccctccttttttgcagctagtgagatagaaactttactctagagggtgtagccaagaacacagggctccagctccatgtattccacctcatagcctcagtcagaaggttttcatcctaggaggaggagtagcgtaccaacatttctcattttgcctcagatgcctgtcactgaggcaaaattctaggtaattgtggctgagtggtggtggttcctttctttcacccagtccctactcctaggatggagacttgaccttgggcaaggcactgctgaaaatactggggctctgatctcctttacccttgcttttcaagccgagaagccctaagtctacagcctcccttcccgtgggtactccacttcgtaaagcagggatgccattcagataaacacaccattgtccccactctagctgtagagagtggctcagatgttttatctggaagcagaagtaggctgtaaaacaggtagctcctaatcttttcctaaaggaacaaagtatggagaagctcaggagtgtggagaaagtcaaaaaaactgcggaggttgttgtgcaaagcaatagggaagagactggttagattcactggagatgcaggataaactagtaggccagctagtttgctggagagaaccaggaaaagaagaagctaggaggagccctttggtatcagaacaactctcaaacactgaccttgggaactaactgtccctttagagggacccaaatttgatctactcagtctgtggagcaatttatgcctcagggtgttattaaaaccagtagagcaatcagctggaaattagtgaagctttaacaactagatgtggtcaaggaaagatacactcaaagaaagtcttacaaaaatctttgtcatccaggatgactgtgggcatacccaaggctgtgccttctaatgagcaatatcacatacttcatacttgaagtttgagggcaaacagactttgcaaaaataatccagctggttactaaacaaatgagcaaatgacaataacaagcctaaggtggaaaaggtgggaccagtagtactcagagttgctaaaatgtctagtttccaacaaagaattatgagctatgcaaagacacaggaaagtatgacccatacactggaaaaaaagcaggtaacagaaactgattgtgaaagtgaccagatgtcacatttaatagacaaagacttcaaagtagccattatatatgttcaaataactaaaaaactatgattaaagaagcaaagaaaggtgtgtgataatgtcatgtcaaatagggaatatcaataaagagatagcaattatatattaaaaaagaaacaaatagaaattctggagttgaaaagtacagtaactaaaatgaaaaattaactagaggagttcaataggctagaactgacagaagaaagaattcatgaatttgaagatagatcaatacagattatgcaatatgaaggagagaaaaaagactgatgtgttggagaagtgtcagacaccattgaacacaccagcatatcagaaatgattaataacaaggttaatataacaaaagatgcaaatatgctcttttcttctcagattctttaaaagacattatataaagtaataagtataacaatataatgttgagtttgtaacatttgtagacataatgtggattacaataaaatcacaaaaaaggggaaaaggaacagacttatataggaatagcattcctgtatctcactggaattaagttggtataaatcagaagctgattctgatgagaagcatattgttagcccagctgggtgctgtggctcacgcctgtaatcccagcaatttgggaggccaaggtgggcagatcacaaggtcaggagatcgagaccattctggctaacatggtgaaaccttgtctgtactaaaaatacaaaaaaaaaaaaaaaaaaaaattagccgggcgtggtggcgggcgcctgtagtcccagctacttgggaggctgaggcaggagaatggcatgaacccgggaggcggagcttgcagtgagccgagatcgtgccactgcactccagcctgggtgatagagtgagactccgtctcaaaaaaaaaaaaaaaaaaaaaaggaagaagaagaagtgtattgttagcccaagagtaactgctaaagaaaaaaaaagtataatcattaagttataatgctacatttgaaaatattcacttaatgcaaaagaaagcagtaaaggtggaataaaggacaaaaacacatgagacatataaaaaacaaaaagtaaaaataaaacatgtaaatccagctatatcaataatattaaatgtgcatggattaagcaatctagtcagaagacagactggattaaaaaaaaaacaagatccaattatatggtgtctaaaggtggcacacttaaggtttaaagatacaaatagtttgaaagtaaatggatggaaaaagaaatataatgcaataaagaaaagataaatgtttgaggtgtcagatatgccagttaccctgttttgatcattacactttatatacatgtatcaaaatatcacatgtatcccaaaaatatgtactacttttattaattaaaaattacatatatgcacatataaatacatatatatacgtgtatacacatatatatatgcatgtatacatatatatacatgtacacatatatatacatatatacatgtatacatatatacatgtatacatatacatgtatacatatatacatgtatacatatatatgtatatatatataaaaatatgcaaaaggcaactatgagaaagctggagtggctactttaatatcagctttttatttactttttatttatttatttgtttatctttgagatggagccttgctctgtcacccaggctggagtgcagtggcacgatcttggctcactgcaacctccgcctcccaggttcaagcaattttcctgcctcaacctcccaagtagctaggactacgggtgtgtgccaccatgcccggctaattttttttttttttttgagatggagtctcaccctgttgcccaggctggagtgcagtggtgcaatctcagttcactacacctctgcttcctgggttcaagcaattctcgtgcctcagcctcctgagtagctgcccgccaccacacccagctcatttttgtattttattagagacgaggtttcaccatgtgggcccggccggtcttgaactcctgacctcaagtgacccacccacctcggcctcccaaagtgttgggattacagacgtaagccaccatgccaggcctgaattatatactttaaataggtgaattggatggtagtgagtaaaacttgaaaataagaataccagttttatgagtaacaactaatggatgcagtttcggtttctttgcagttcagcttgtccttagagaataaattccactgaggacgtacagtcaaaataacgtgagctaaaagtcatttgaagtaattcttttttctctgtggttatgttaccaacttgattgttagttattgcattaattgacttttcctatactgaaacaacaattccagaattttagtagcttataatgataaacatttatttcttgctcaggttctgtgagtccactctagtggttcttctctaggccccaggttcagttcaggtctacctgtgtgtcttctcatcctgggacttcagttgaaaacacagctcccatataagataatgtaggtcttgtggagggcatgggaacacaagagggttgctagaatttgcagcgactcctaaatcctttgtgtggactggcacactgtcacttttatccatatttgtttgttttgcataaaaggttaaattacgttttgttgttgttgttgttgttttgagacggagtctccctctgttgcccaggctggagtgcagtggcgtgatctaggcttgctgcaagctccgcctcccaggtagctgggactacaggcgcccgccaccacacctggctaattttttgtatttttagtagagatggggtttcaccgtgttagctaggatggtctctatctcctgacctcgtgatccacctgccttggcctcccaaagtgctgggattacaggtgtgagccgctgcacccagccaaattatgttttttacttatgtgagtttgtaatgacaccaccacattcactatcccccagttcttcctcattttgccccattccatattttatctttccttgtcctcgtgacaatatcggttcccaataacactactgtatgtatttattctattctacaatacacacaatatagtttaaaaattaagatagtaatatcactactaataacattatatgaagagtttaagatatttttaaatttcttttgcttttagaaaggtaccactaaagatgtccattcagaaaactgttcaagaattatttgaattatattctgtgtgtggttatcaagtcagtaggttttttctttttaaagatggggtcttactctgttgcccaggctggagtgcagtagcacaatcatagatcatagctcaccataaccttgaatttctggactttgcctctgcctctcacctctcagcctcctgagtagctgggactataggcacccatcatcacgcccacctgacatttttttttttttttttgggtaaagactgagtctcattattttccaggctggtcttgaactcctggtctctggccccaagcaatcctcttgcctcagctacccaaagtgctgggattacagattgagccactgcgcccagcccaagttggtgggttgtctttttttttttttttgagacggagtctctgctctgtggcccaggctggagtgcagtggcatgatctctgctcactgcaacttctgtctcctgggttcaagctattctcgtgcctcagcttcctgagtagctgagattacaggcacccaccaccacacccagctaatttttgtatttttagtagagacggggtttcaccgtgttggccaggctggtctcgaactcctgacctcaggtgatccacccgcgtcaggcctcccaaagtggtgggattacaggcgtgagccactgtgcctggccaagttggtggttttttaaagaagataaaatacagtttgaattcatactgatatttacaattcaaattaaggattataaggttttaagtttcattattcttatatctgtgtctcctatctcccattgtgaaaatactgattcccaacaataccaatgtaagtattcatttgcaactataatacccgcataacagtaccaagataacaaacagtaccaacagtgttgataattatgattactgaaaaaaattcaaagtattactgaaaacaaagtattatgaaatggataagtagtgcagttaagctaatagtgataatctctcagttatttcagctgccaatgaatttctttgtgaaatcatattcaaagttttagaaaaaatgtcgaaggtcctgttcaagcttaaaactatacttgggcgggcacagtgtggctcacgcctgtaattccagcactttgggaagccaagccgggtggatctcctgaggtcaggagttcaagaccagcctggccaaaatagtgaaacccggtctctactaaaagtacaaaaaattagctgggcgtggtggcaggtgcctgtaatcccagctattcaggaggctgaggcaggaaaattgcttgaacttgggaagcggaggttgcagtgagccgagatcgtgccattgcactccagcctgggcaacaagagcgaaactctgtctcaaaaaaaaaaaaaaaaaaaaaaccctaaatctatacagttgaaagcaaaataactcataggataataaatgtatgtaataaaccagataataggtgctctgagaagttttgagtatatttagtcttttatcaaagtttattggcttattgcaaatcatgcgttaactttctgagttggagagaaaggctgatgaaattattgtcgtagctagattttctctttggattggtaaatgttctgcatcaatgcctgacactgaggctgccagcggaaagcttagccatagcacagagtagaatatgaaaaactagggtgtgtcaaggcaaagaagttggagattgaagatgtatgtgcttgagcgaaactctagtagtaatgtctttgtgttccaaagttattggtaaatataacagtagcaaagaaccattttgttgcactaattaaattagtagtcttgaggattagttattggagaaggatagaggtgatctaatgtctctgattttgctaatcatcttgatgtagtagaattcctttatatagcatttggtgtggtggcattgtcgaaacagataagaacagctttttactaggtaataattgttttgtcatagagcatttgatttaccatgtactgaataattagcagttttatagttggggtcctattcccttttttcttttattttttgtttttaagagacggggtctctcttgaccatactagactcaatcacctgagctcaagcgatccacccacctcagcctccgcagtagtgggacaagaagcgtgtgccactgtgcccagcttattgctttttgtctattgcttttttttttaatccttataacctgcctctatcaatctatcttaaaatgatgtatgaatgttattaagagtgaatttatttttctttttttcttaggagcagccaccatatcctagctacaattctaactattggaattctactgcgagatctagggctccttacccaagtacatatcctgtaagaccagaattgcaaggccaggtatggtttaaaaacagagactttctgaactttttcttaatgaatagatttattttcaaaacctgtgcagattttagagcagtgatgagtgtgtgttttttttctttgctttaatgggctccatcaatctcatcttaatgtttttagctcagagataaggaaatatctaggcaaatatacctatagcttgaggcataataaattattttccaggacccagaaggaacaaacataaaatatacttatttttgaaaactttactgattacagacatttaatttaaaatattttaaaattataaaaagtacagaaaatatatacattttaaatctagcatgcagggctgggtgcagtggctcacagctgtaatcccagcactttgggagaccaaggcaggcagatcacctgaggttaggagttcaagaccagcctggccaacatggtgaaactccatctctactaaaaatacaaaaattagctgggtgtggtggtgggcgcctgtactcccagctactcgggaggctgaggcaggagaaccgcctgaacccaggaggcggaggttgcagtgagctgagatcacaccattacactccagcctgggcgacgagtgagactccgtctcaaaacaaaaaacaaacaaaaaaaccccacgaaaatctagcatgcagatttgtcaatttctgtttgccacatttgtttcagatttttaagaaagaagtaaaccaaatacaattgaagcccaatgacacttcttttcatttactgaaattttatttatttatttatttgaaacagggtcattttctgttgcccaggctggagtgcagtggtatgatctcagctcactgcaccctcctcctcacaggttcaagtgattctcctgcctcagcctcctgagtagctgggactacaggcacacaccaccatacccagctaattttttgatttttttttttttttttgagatggagtcttgctctgtcgccaggctggagtgcagtggcatgatcttggctcattgcagcctccgcctcctgggttcaagtgattctcctgcttcagcctcccaagtagctgggactacaggcatgtgccaccacacctagctaatttttgtatttttagtagagatggggtttcaccatgttggccagtatggtctcaatctcttgacctggtgatctgcctgcctcggcctttcaaagtgctgggattataggcgtgagccaccacgcccggccagtttttggatttttagtagagatggggtttcaccatgttggccaggctggtctcaaactcctgacctcaggtgatccgcccaccttggcctcccaaagtgctgggtttacaagcatgagccatcgtgctcggcctgaagttatatttattaccccatttgtgtttttgtgcctttactacttgcctgtgtatccataaactttatatacttttattttacatgtttttaaacttgagatgtgtgatttcatactaacaaacacactcctgcagcttgcttcttttgctcatcgttggttttcatctttctgttatataaatacgagataagaatttccttagggtctggaatttttgggtttaggtgtgtactttttttttttttttttttttttttgagatagagtctcaccctgtcacccaggctggagtgcaatagcgcgatctcagctcattgcaacctccgcctctcaggttcaaatgattctccgcctcagcctcccgagtagctgggattacaggtgtctgccaccatgcccggctaatttttgtatttttaatagagatggggtttcaccgtgttggccaggctggtctcgaactcctgacctcgtggtccgcccaccttggcctcccaaagtgctgggattacaggcatgagccaccatgcctggccaggtgtgtacatttttattagatacagccaaattacttttcaaaatggttgtactaacaaaggagtaattgtcatatttgcatatttccattatatttttttatctagccatattactggggtgtttttttttgtttttttttttttttgtttttttttttggccgagtctcgctctgttgcccaggctggagtgcagtggcgcgacctcggctcactgcaagctctgcctcccgggttcacgccattctgctgcctcagcctcccgagtagctgggactacaggcgcccgccaccacgcccagctaattttttgtatttctagtagagacagggtttcactgtgttagccaggatggtcttgatctcctgacctcgtgatccacccgtctcggcctcccaaagtgctgggattacaggcgtgagccactgcacctggcttttgtttgtttttttgagacagggtcttgctctgtagcccaggctggagtatggtggcatgatgacagctcactgcatcctcgacctcctggcttcaagtgatcttcccacttcagcctcctgagtagctgggaccatgggtgcacattactatgcccagctaatttttaaaatttgttctgtagagttagggtttcgccatgttacccaagctggtctcccaatcctgggctcaagagatcctcccacttcagcctcctgagtagctaggactaaaagtgtacatcaccatgccttgctaatttgtttgctttttttgtagagacagggtcttgctgtgttgcctaggctggtttcaaacccctagcctcaagctatcctcccaaattggcctctcaaagcactgggattacaggtgtgagcccttgtgcctggcctataataatcatgtatatatgaacttaaggatgaggttgatcagagataatggaatgtaaaataaagatcatgttagtacttaccacaaactttcattttacttgtgtcagcctcatccctgtgactgaaattgagaagtagacattgttattgctaaatgttacatagttgtggtttggccacatactataaaatccacccttcaaagtgtacaattcatttggtttttagtatattcacaaagtttacccattatcactgtctaattctggaacactgtcatcaccccgaatagaaaccctgaacttgaaatgtcattactccctcccctcagctcttggcaacctgtaatctacttttttatctctcaggatttttctaaccagacattttgtatggaatcatacagtatgtggcattttgtttctggcttctgtcactgtgtaatgttttcaaacttctccatgttctcaggatataccaaatttcatcaattgatagatatttgggttgtctttcgtttttgtcttttataaatgatgctgctacaaccttcatgtacaaatttttatgtggaaatatgtttttatttatcttgggtctatacctagaaatggaattgcttggtcatagagtaaccctatatgtatcaatttgaggaactagcaaacggttttccaaagggattgcaccattttatagtcccatcagcaatgtatgagggctctgatttctccacatccttaccaatacttattttcctttaaaaaaattattataggccgggcgcggtggctcacgcctgtaatcccagcactttgggaggccgaggcaggcagatcacgaggtcaggagattgagaccatcctggctaacatggtaaaatcccatctctactaaaaatgcaaaaaattagccgggcgtggtggcgggcacctgtagtcccagctacttgggaggctgaggcaggagaatggcatgaacccaggaggcagcttgcagtgagctgagattgtgccactgcactgcagcctgggcaacagagcgagactctgtctcaaaaaaaaaaattatagccatcttagtgggtgcaaagtggttttgatttgcagttctctgatgactaatgatttgagcatcttttagtgtgcttattagccatttgtatatcttgtttggagaaatgtctatttagattctttgggcctggtgcggtggctcacacctgtaatcccagcactttgggaggccaaggtgggcagatcacttgaggtatggagtttgagaccagcctggccaacatggtgaaaccccttcactactaaaaatacaaaaattagctgggcgtggtggcaggcgcttgtaatcccagctacttgggaggctgaggcaggagaattgcttgaacccaggaggcagaggttacagtgagccgagatgagatcacgccattgcactccagtctgcgtgacagagcaagactctgtctcaaaaaagaaaagattccttgaccattttaaaattgggttgtctttttattgttgagttttaagcattctttatacattctagatacaagtttcttatcaaatgtagtcattcattgcttaataatggggatattttctcagaaatgcatcaagaggcaattttgtcattgtgcaaacatcatagagtgtactttcacaagtctagatggtacagcttactatatacctaggctatatggtatagcctatggcttctaggctacaaacctgtacagcatgttactgtactgaatactgtaagcaattgtaacaccatggttagtactggtgtatctaaacacatctaaatatagaaaagatacagtaaaaatacagataaaagataacaaaatattatatcacacttgtacagggcatttgccatgaatggaacttgcaggactggaagttactctgggtgagtcagtgagtgagtggtgagtgaatgtgaaggtctaggatattactgtgcactattgtaggctttataagcattgtacacttagtttaccataaatttgtataacaattctttcttcaataaatactgtaacttttttactttataaactttattttattttaagttatttttttgagacagggtctcactctgtcccccagactggggtgcagtggcgtgatctcggctctctgcaacctccatctcctgggttcaagcgatcctgccacctcagcctccctagtagctgggactacaggcgtgtgccaccacacctggctaatttttgtgtttttagtagaggcagggtttcatcatgttggccaggctggtcttgaactcctgacctcaggtgatctgtccacctcagcctcccaaagtgccgggattataggcctgagtgagccactgcacctggccttataaacttttaaattttaaaaagctttgactcttttatagtaatacttagcttaaaatacaaacatactgtacagctgtacaaaaatgtttccttggggccgggcgcggtggctcactcctgtaatcctagcaatttgggaggccaaggcgggcagatcacgaggtcaggaaatcgagaccatcctggctaatatggtgaaaccccgtctctgctaaaaatacaaaaaattagccgggcgaggtggcagtcgcctgtaattccagctactcgggaggctgaggcaggagaatggtgtgaatccgggaggcggagcttgcaatgaaccgagatcacgccactgcactccagcctgggcaacagagcgagactcccatctcaaaaaaaaaaaaaaaagttttctttctttttttttttaatttctttatatccttattctattaagctttttcctgtttttaaggtttttttgttttttgtttgttttttgttttttttttttgagatggagtttcactctgtcgcccaggctgcagtgcagtggtgcgatctcggcttactgcgacctccgcctcccaggttcaagcaattctcctgcctcagcctcctgagtagctgggactacaggcgcccaccaccacgcccggctaattttttgtatttttagtggagatgggtttcaccgtgttagccaggatggtctcgatctcccaacctggtgatctgccctccttggcctcccaaagtgctgggattaaaggcgtgagccaccatgcgtggctgtttttgtatttttaaaactgtttgtgttaaaaagggagacgcaaacatacattagcataggccaacctagggtcaggatcatcagtatcactgtctttcacctcctcatcttggggcaataagacaggtgggaactgtcatctcctatgataaatgcctggttctggaatacctcccaaaggacctccttgtggctgttttccggttaacctttaaaaaatgtacaagtagaaggagtacatgctaagataatgataacaaatgtcgtatgtagtaaatacataaaccagtaacatagtcaattatcatcatcaagtattatgtattacatataattgtatgtgttatatacaactggcacacagcaagtttgtttacaccagcgtcaccataaacaggtgagtaatgcattgtgctatccatatgacagctacactgttgcaaggcaatacaattatttggctccattataatcctatgggaccactgttatgtatgcagtccactgctgactgaaacatagttatgcagtgcatgactgtatatgatttgcaaatagtttcttccattctgtgggttggcttttcacactcttgatggtgtcctttgaaacacaaaagcttttaattttgatcaagtgcaatttttttgttttttattttgttgctcctgcttttgatgtcttatccaagaagactttgactaaccaaagatcataaagattcactcctgtgatttctttttttttttttttgaggcagagtctcgctctgtcgcccaggctggagtgcagtggcacaatcttggctcactacaagctccacatcccaggttaaagtgattctcctgcctcagcctcccaagtagctgggaataaaggtgcccgccaccacacctggctaattttttgtttatttagtagagacagggtttcaccatgttagtcaggatggtcttgacctcctgacctcgtggtccacctgcctcagcttcccaaagtgctgggattacagacgtgagccactgcgcccagcccgatttcttctcagaatttttttatagttttagctctcacatttaggtctatgattcattttgagttaatttttgcaatatggtgcaaagtaaggcccaagttcactgctttacatgtggatagttatgtctcagtatcatctgttgaaagactatgttttttccactgaattatcttggtacccccttttttttttttttgaaacagagtcttgttctgtcgcccaggatggagtgtagtggtgcaatctctgctcactgaaacctctgcttcccaggttcaagtgattcttgcctcagcctcccgagtagctaggattacaggcggctgccaccatgccgggctaattttttttgtattgttagtagagacagggttttaccatgttgcacaggctgatctggatcgcctgacctctagtgatccacctgcctcggcctcccaaagtgctggaattacaggcatgagccaccgtgcccagcctgggtacccttcctaaaaatcataaatgtaagggtttatttccagactctcaattctgtcccattaatctatatgtcttccttaagccaataccaaactgttttgattactgtggctctgaagtaaaatttgaaatcaggaagtatgagtctctccaaagagatggactctctctctcttttttctttttcttcttccatatggtttcggctattctgggttgcttacattttcatatgaattttaggatcagcttttcaacttatgtaaaaaaggcagctgagattttctttttttctttttttttttgagctggagttttgctcttgttgcctaggctggagtgcaatggcacgatcttggctcacagcaacctccacctcccgagttcaagccattctcctgtctcagcctctggagtagctgggattacaggcatgcgccaccacgcccggctaattttgtatttttagtacagatggggtttctccatgttggtcaggctggtctcgaactccggacctcaggtgatccgcttgccttggcctcccaaagtgctgggattacaggcatgagccaccatgcctggccaggcagctgagatttttattgagattgcatcatagatcagtttggagagtagcatgtgtacttttatagttaatgtaagagggagacaaaactcatagtcatgaattataagttaatgttaatttttctgatttcactgatcttactgataaagattgctttttctcataacattttcccccttaggtaaaagtatttattacattcatatgtaggttcaaaaaagattaacttataatttagtagtaactttttaaaagcaacagtaataatgtgcaaatgtttttagatacaacatacaagttgttggatttaaaataacccaaaggtgtctagacatacacctttttgaggtgagcacatgtgtattttctggcgaaacatcacatggggattatacatttatcatcatcttttttttgtttgtttcttgagatagatagtcttgctctaccacccagttcattgtagtggcataatcatagatcactgtaaccttgaactcctggacttaagtgatcctcctgtctcagtgtcctaggtacaggtgcgtgcaaccacacctggtttaatttttaaatattttgcagagatggggtctcattatgttgcctaggctggtcttgaactcctgggctcaggtgatccttctacctcagcatcccaaagtgttgggattacaggcgtgagccattgcacttggtctagcttctatccaagatagactcctatagtggtatatagatatgactggtttcctttttaaaaaattaagcagtatcatgtctttaccttccggctacctccttgggttagccttgccacatggtcattcttctgtttggttggttttataaatcttaaaaattctcattcaaaagtagctataataagccaagaatatgtaatttcatgcatttattctgagtgtggaatttatatatatatatatatatatatatatatatatatatatatatatatttttttttttttttttttttttttttttaagaagctgttaatgttgctaaggtgtctgaccaatcttccaagttgattagcctgccatgtgccaggtgcagtttatgtgctatgcaagtattagggcagcatttgaactaaagccttcctcatttttcagaacttcattctttaactaatagtgtggactcttgagaggagcatggagggcgattcatggagtagggtgtgaacagcacggaagttcacaatctcaggctgtatctctggaagcagaagatattgtctcacccaactgttaataaagttcgtgaggttttctcagtattattcaaactcggttgagttgcttctgctttgttcttaagtccttctttttccttttcttttctttctttttttgagaccaggtctccctctgtcacccaggctggagtacagtggtatgatattggcttactgcaacctccacctcctgggctcaagcgatcctcccactgcagcctcctgagtagctgggactacaggcacatgccaccattcccagctaatttttgtattttttgtagagagggggttgcccccgcttatcttaaactctttgagtttaagcagtccacctgccttggccttccaaagtgctaggattacaggcatgagccactgtgctcggccccctttttttttttttttctgtttctcaggctggagtgcaatggcatgatcacagctcactgcagcctcaatctcctctggctcaggtgatcctcccaccttaactgcttgagtggctgggaccttaggcatacgccactacacctggctaatttttgtattttttgtagagatggggtctcactttgttgcccaggctggtctggaactcctgacctcaagcgatccacctgccttggtctcccaaagtgctagaattacaagaatgagctaccacgcctggccaagtccttcatttttatgacatactttaatatgtaacagaaatctgttctgaagtcctagaagcattttcttcctttttggattccgtcttatgactctaaatggtgcaaggaactcctgtattttctttgctgtgctccaagtgtcaacctaaaataacaacagagagaaggactcttcaaagaaatgaatctgtttggaaataaacagagaattacaatttcagatgcgcataccatagataatcatcccctacatatctggagaagttgtagtaaggggaaacttttaaagggaaagaggagaagtccatataagctgttttgagacaaacatcattggtcacaggggcctgttgtaggagctgatgttactggaaactcattgctaagcgagtgttcttatgaagatggcttatgtgaaactgcagtcttgaggaattttttttttttctttttttggacagagtttcactctgtcgcccaggctggagtgccatggcacgatcttggctcactgcaagctccgcctcccgagttcacgccattctcctgcctcagcctcctgagtagctgggactacagtcgcctgccaccacgcccagctaatttttttgtatttttagtagagacagggtttcaccgtgttagccaggatggtctcgatctcctgacctcgtgatccgcccaccttggcctcccaaagtgctcagattacaggtgtgagccaccgtgcctggttgaggaattttttgtgataagtcctgttacagacatatgtaggacaagcaagatgagtagggcctacagggattttttgtgagtttttagaaagccctgtgatataggctgggtgcagtggctcatacctgtagtccaagctacttgggaggctgaggcaggaggataacttgagcctgggagatctaggctgcagtgagctatgatggtgccactgtactctagcctgggtgacagagtgagaccctgtctcaaaaaaaaaaaaaaaaaaagtccttgtgataatacttatcgcagacatgtgtgcatgagatcccctccttcgtgacctccccctccattttgggtctgatgtaagtgactccatcttggcattggcaactttcacacaagctgcttttcagacaaagacttaaaaactttgccacgtttctgaaataggatctttagctcatccttaacaaacatctttagcaactgcaaggctgttatataatctgattctgtgttcttttgtaaacatgcatgtgacagctttgtgatctgtcaggacagtggttatttgggaaaagaagcaatgaactcatgaaggcatctcaaaaccaggaagtaattccaggaatcaaggaaattttcaagcatcaaaagtaatggctggccagatgtggtggctcacacctgtaatcccagcactttgggaagctgaggcgagtggattgcttgagcccaggagttcgagatcagcctgggcaacatggccaaaccctgtctctacaaaaaatacaaaaattagccaggcatggtggtgcatgcctgtggtcccagttacttaggatgctaaggtgggaggattgcttgagcccggagtttgaggctgcagtgagccgtgattgtgccactgcattctaccctgggtgtcttggggagaaaaaaagtaatggccaggcatggtataatcccagcactttgggaggctgaggtgccaggatcacttcagcctaaaagtttgagactagcctggcaacatagcgtgacctcatttctatttaaagaaaaacaacaacaacgaaaaaaaaaacaaaaacaacgcctgtgagaagggaaaaagaaaaaaaataaacaacaaaagccacataaaagcaatgagaatcacacactaaagtaacatgaacccatctattggtttcaatgggttatcagtacatggccgtcgtgtatttattcttggagtatttccttggagtattttgaagcaatttcagatatcattttatcacttataaatacctaagtatgtttctttaaaatataaggaagttttaaaaacataaccacaatgtttttaaacatttttaattaaaaattaaaacttaaaaggaaaaaaacaaccttaaaaataattatttcatatcattaaatatctggtcagttctaacagtaaaatatttatttagttagttagctagttgaagacagggtcttactgtcacccaggctagagaacagtggcttgattatagctcactgtaacattgaactcctaggctcaaacgatcctcctgcctcagcctcctgtgtagctaaggactatagctgtgccataccacgcccagctaattaatttttttttttttttttttttttttttttgtagagatgaggtcttgctgtttgcacaggctgttctcagactcctgggctcaagcaatcctcccaccttggcttcccaaaacgctgggatttttacaggcatgagtctgtgcgcctagccataacaataaaatttgaagactgaatacaattttttcaatgaatagtctttaatctacttaaagattccattgttataggacatttaggtagtttacaattttgtgtgattgtaaataatgctgcgatgaagaacttcatgtctataactttttctctagttgaatcatttccttaggatttctagaagttgaataacagtacaaaaagtcacataatgttttattaagtctccaattgtgtgtgtgatgtattacggagttctttgtttatgcccgaagaccttaacagcctcttagtagttttaacatagtggtggttcatggtcttctgctcagggaatgcattgctgactgtttattatacctcatcctgcatggaattctttggtcatgggtatcctcatacctaaagtgggaaagattatatagtcttcgagatagagatgagtataggaaaactggattctgtgttttcactgtttttaaagggtaaagtagaaattaatagaacacgttgaggtgatcatttaaatttagcattaagcttgaatctttttttaaaaattacttttttttttttttttaaatagatggggtttgactatattcctgaggctggtctgtaactcctgagctcaagtgatcctccctcctaggctggatgcagtagctcatgcctgtaatcccagcactttgggaggctgaggcgggtggatatgaggtcaggagttcgagaccagcctggccaagatggtgaaatcccatctctactaaaagtacaaaaattatagcatgcctgtaatcccagctacttgggaggctgaggcaggagaatcgcttgaatctggggggtggaggttgcagtgagccaagatcttgctactgcactccagcctgggtgacagagcaagactccatcttaaaaaaaaaaaaaaaagtgatcctcccttctcagcctcccaaagtgctgggattacaggcatgagcctgtgcgcctgcctagcttgaatcttgtttggattattaaactgaggattctgggtgtggataagagtctgaataggttatttaaaactacagtgagcaatatatgaggagtttgttgttggtatcatttgggatgcagagtgatggtgtaatacaaagaactggacttcagagtcagatctgggttcatgtcatgacccagccatgataatactaacaacagtcataatacaaataattaccatttattgagcatactatatgccagacactatgctaaaccttttatatatgtcatcttatttaattttgacagtaatcctcaaagatacgtttatgatcttcattttcctgatggagaaactgaagttagggaaggttaaatacaaagcctatggcagagctaggtctgtctctatagtctttttaaataatttttttgttttcttatactttctgagacagagtctcactctgttgcccaggctggagtgcagtggtacaaccatgactcactgcagccttgacctcctgggctcaagcaatcctctcacctcagcctcctgagtagcttggactacagatgtgtgccatgaggcctagataattttttttttttttttttttttgagatgaagtcttactcttgtcccccaggctggagtgcgatggcacgatcttggctcactgcaacctccgcctcctgggttcaagcgattctcctgcgtcagccccccgagtagctgggattacaggcgcctgccaccatgcccggttaatttttgtatttttagtagagatggggtttcaccattttggccaggctggtctagaactcctgacctcaggtgacccacccgcctcggcctcccaaagtgctaggattacaggcttgagccactgtgcctggcaatgcctggctaattattttattttatttttgtagaaacagggtctcactatgttgtccaggctggtctcaaactcctgacctcaaatgattctcccaccttgggctcccaaagtgctgggattacaggcatgagccactgtgcctggcctgcattagtgattaacatcttctcaaagttttcaagtttaggcattaagtcagggcatttcagctcttctactaattcatctttttttcactcaacttggtttttttcagagtttgaattcttatacaaatggagcgtatggtccaacataccccccaggccctggggcaaatactgcctcatactcaggggcttattatgcacctggttatactcagaccagttactccacagaagttccaagtacttaccgttcatctggcaacagcccaactccagtctctcgttggatctatccccagcaggactgtcagactgaagcaccccctcttagggggcaggttccaggatatccgccttcacaggtgagttgttttctattgggaaaaaaatgaattcaaagtctctgcctcttgtaaacagtggaagagcatctgttcatactagtgctgatttaataagacacttctagattgggaaggcttttatattgatgcctttcttatttgtggcagctattgcagtaaatggactttggctgaaggtcataatcataaatttttatactgaaagtaatctttagagagttgctgcttgaaagtttccctatcttagccttttttttttttttgtggcgtgatcttggctcactgcaacctctacctcctgggttcaagcaattcttctgcctcagcctcccaagtagctgggattacaagcacgcgccatcacgcccagctcatttttgtatttttagtagagatggggtttcaccatgttggccaggatggtcttgatctcctgacctcgtgatctgcccccctcggcctcccaaagtgctgggattacaggcatgagccaccgtgccaggcaaatcttagccttttttagcaccctgttaggttcttttttttttttttttttttgagacggagtctcgctctgtcgcccaggctggagtgcagtggcacggtctaggctcactgcaagctccacctcctgggttcatgccattctccggcctcagcctcccgagtagctgggactacaagcgcccgccaccgcgcccagctaattttttttgtatttttagtagagatggggtttcaccttgttagccaggatggtctcgatctcctgacctcgtgatccgcccatctcagcctcccaaagtgctgggattacaggcgtgagccaccgcgcctggccaggttcatgtttttttaatattctgtgaataactatgtttatttctctgttcacttcaagaggagttctaacatgtctttatttgtgcttccttatagcatatgggtccgtttgtttatagtatctatgggacagacttgggtttcatccattgaatttttaggccttattccttctgagttttattgtcattaaatctacccctggtatctttggaaccaactttttgaggcttggagaaattactgcagctgattaattagatttactacagtttagtccggtagcagctaatgtatactctgttaagaagagaggaagcatctcagaatctgcctgtagcagaatatttttattataagtttttcacaatgactggtatatttcttcttctcaatctagaaccctggaatgaccctgccccattatccttatggagatggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaaagtacttcaccatggcctagcagtggctctccccagtcacccccttcacccccagtccagcagcccaaggtaggagacctaaatgttgttcctttaatgtgtgtgtaattaggagaacataacatggtttatatagtttctgtactggtttgtgttaaatggggactaattacaaaaagttggtgactacttatctatagctttacctcagctcggtttcctttttcttttttttaatagactttatatttagagaagatttagattcacatcgtttttgttaaaagacagaaagatacacattttctgtttgttgtaattcttctaaacgttaaatgcaaagatgcattttactacttcaaataatctatgaacagaagacaaaaccaatgtgaaatatctgtagcatgagcttgtatttaaaccacagacttgaacattatcacttgtggctgtgttccttttcaagaccttgcttgaggtttttaaccttttaggggaaaaactaattcttattaattaggtcacaggatggactatgaggtgctcatggtgatggacctgccacagggcaggttccagccattataactcaaaaattctgtgccttttgtctgacagggcactcccttttatcttcttaggactgtgtttttttgcaaatgattaaggagaggggtccaattttattgttagggaatcttttcatgtacctttctggtcaagtgaaagatgtgggctaacaaatttgatgttgatgcattcccattaaaacagctcttttcctctttttgctctcccactccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaattagaaaaaaaaggattatgaaaggatttagaacaaagtggaagcctgttactaacttgaccaaagaacacttgatttggttaattaccctctttttgaaatgcctgttgatgacaagaagcaatacattccagctttcctttgattttatacttgaaaaactggcaaaggaatggaagaatattttagtcatgagttgttttcagttttcagacgaatgaatgtaataggaaactatggagttaccaatattgccaagtagactcactccttaaaaaatttatggatatctacaagctgcttcttaccagcaggagggaaacacacttcacacaacaggcttatcagaaacctaccagatgaaactggatataatctgagacaaacaggatgtgtttttttaaacatctggatatcttgtcacatttttgtacattgtgactgctttcaacatatacttcatgtgtaattatagcttagactttagccttcttggacttctgttttgttttgttatttgcagtttacaaatatagtattattctctacttcttggtacattttgtagtaatatgtttaatataattattcaagagactatattgacagccagatagtatggcagttctgaaaaaatttatatcttttcaccacttgaatatactgcaatgtgtagtgagtaaattgtctccctttttctatagatcattaggttagagtttttttcttcttttttttttttttttttttttaccacttctgctgttcatggtagtagtggaaggtaaatttggaaatggcattgacataaaatgaaaatgtttacggacacttttcttttttgcttttttattgtatttggataaagatccacttaaaagttatctgttttttcctgttttttttttttttccccaaagtgtagttatgttttcactattgctgcttctatagagggcattgtgatagagagttacagatgaaacattaaatgccacagtgagtagaaataattactacaaaaagtaataaatatgattacttggtaatatcattctccatctaaaatactagtttcacctgtgagcagatttcagctcagtttatagttaaaaacaatgagggtaaaatgggattcatgctcagggaatgaatcagccatagttagagtgggaaattattattttcttcatttaaaggtagattttatgtttatttccctaaattgcataagataaaattgtctgtttaataaaaagacatttattaccattattaacagtcattttagagccaaatttaagaaaaggatattgaaagggtctttattggccttgtttgggtaactctatgctgttagatagaagagacttaggtaaataactttttatgtctgaggtgagtacacaatattggttcttggaaaaatagctgtttcttcataagatacccaagtgataattttttttcccctagactgtcaggcctatgagtaaatactaaatctattagctgtccccactcataaaccaaaccaaaccaatacaaacagatgaggagaggaaatgtagtaaaaatactggctgggtcttatgattgggatgagtgattttataagataatatggtgataattttattctaggattttatttttggcctaatataggaatgtttaaaaaaggcttttctatgaaaattagaaatttatacttgaaattaaaagtctagaagggggaggaccttaaagctaagctaccagtaagacaatgaataattcagaagagaacactattcttttactgactgagtgcccaagatgccaatttccatgaagtcttgatttatatatatgtacacatgttatgcacatacatgtttgttttctaacagttattttttaagcttttgagataattttagacttacagaagagttgtaaaagtagtagagttcttgtatactctgcacccaccttgcccttatgttaacatcttacgtaacaatagaacatttgtcaaaattaagaaattaaccttgatataatactaactaaagtagaaagtttaaaaagtagagattttagtcttttcactaatgtccttttactgttccaagacccagccttgcatttagctatcatgcctacgtcctgtcttccagtctgtgacagtgtatcataacaggggatacctgatgttgtaatgtatttctggtgttgttaaccttgatcactatgctaaggtggtgtctgctaggattcgctactgtaaacttactgtgttttccttgtaattattgaatatttgctggagatacccggagactatgcaaatgtcccgtttctgcttaaacttttgctcattttactatccattggcagatcttgcttgtggcagttactactgtggtgttctaatggtgattttctatttctctcaatccttctacatttattattggaattcttctgtaaggaagagttgtcagttctggatttatatttttaactataataagatattcaggataagtatagatttagaacttaaagatgttaaatcatgttaaaattattccaaataccaatatcaaagaaaactaagttggtaatctatctcagaaaatatatgaacttaagaaggaaaatagtatttatgatttgtagaattggttcaacttttgacttaatactgactttggactgaattcaaagttttcttgaaatttcacatctggactttttaaagtgtctacatttatattactttggggatcattttgtcaaagtcttgaataaagttacccagtcctggcatgataaacacaa

SEQ ID NO: 3 - DNA, 33225 bp, Homo sapiens
gccccagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggtaggcctcgcaatgtattcaagttactccaggggcagtgaagaccgaggacaggccatatttttgactcttttgtgggtggtgtcgggttggcggcgaaaggagaaccaaggagacgttgcgccgttatttatgcgttttttcgttagcttctctcaggttttcgaggcactacgggccgaaaaggccgggcgggggcgctgagcagtgctaacggcgggcgcgcgcgtgtttgcgaacctgcctggagacccacagcccgcgcggcctcccgtgcgcgtgcgcatatcttcctcttccacccttcccccatttcttcagcccgtacctctgcgcgcgcccgactgaacgctccgcgcacgcgcgctcgttcatttttctctcccccgcctatggcgccgacggccgctggaggtgcaacttgtgtccgcctctcattggctgggactgccacctttcttcgtggcctgtggggttttgagaaaataactgtgacccgcagcaaagtgcgttgagtaggtctaccccttttcgcgtggtctttaaaactgccctccggcttcagaccacccgtcagttaatgcctcgtttttgtgatgctactaggttttagtgctctgttctgcctctcgctgctgaccctggttctctggagttaatttcggtacccgcggcaacctgctgttttgaagcgagcgcgcgctgttgactggtgctggttgcctagttacggttccctagcgagaggattgggtcttagctggtggttctgagcgtggccctgccccatccggctgaaagtgcggttcttcatgagtactagcgaagccgagtcttttcaagtgattcagcccatttagtcgtgtcagaaatgttgcagccacgattggtggacagctggtgtgagaaatgggtgggagtggcgaattggactttgccttcattttaaattcatgagttggcttgattcgcttttaagatttatttcttcagaatcaagctgaagtaccagcagctactttgctacctcagacttttttaaaaagcattttagaactggaaacaaattaagactgaagttgaaagcaagtgtggctaacactgacgaaaaagatgagctacttcagacttgtacctcactgcaacagcctcttttaaattttttggtgttacaaagcaaaacaaaatttcttgttcctcttgtgaattctcatttcagttcgactttagttggaatggttaggatactgttcaggcagtaaataacctttacgtaggaaaaactgctacaaggcttttgtatttttgtttgatcatgaccaattcaggataggtaatttgatgggagggaaaaagtggcccctcggcgggagtttgaggctgctgtgagctgtgctcgtcccactgcactccagcgggggcaacagagcgagaccttgtcacttaaaaaaggtagctcatggtaaacaaccttggagcaccttctcttagtgatttcatgtttcaaccagtacattgtggtgaatactgaaatatcttgtttaattcagataattaaaatggtggcaaaggaagctgtttagccagagcccttcttgactttgaggaacagtggtagtataagacttgaagacagacgtgtaaaaagtactactcactggtaggctcaggtctggttgattgactgattcttgagacggaatgtcgctctgtcgcctaggcaggagtgcagtggcccagtctcggctcactgcagcctccgtctccgggtccaagcgattctcctgcctcagcctcccgagtagctgggactacaggcgcccgccaccacaccgggctaatttttgtatttttagtagagacggagtttcacaatattggtctcgaactcctgacctcaggtgatccactcgcctggcccacccaaagtgctgggattacagggatgagcccctgcgcctggcctcggttgaatttattaaacaacttttgtgggcagcaagctgtacgaggttaactatgtgatgagaagacttagaaatggagaaaagttttatcagttctacataggacttagtttgggagtttctggaaactacgttggaaatcagtagttgcacactagctgaattcagctgtgtaatttacagtgatttgttatttaccaaataagtagaagagggaattaagaagctaaaatctctgggtacttgtttgatatgaatttgttaattgtttatactcaggtaataagtgttacctcagtcatagcatttaatattttatctgactgtccctaaggctgaaaaccaacgaatatactaacacgaagataatactagattatatttgtgtaatattttagagttttcaaacactttaattttatttatttatttttttgagacagagactcgctctgtagcccgggctggagtgcagtggcgccatctcggctcactgcaacctccgcttccctggttcaagcgattctcgtatctcagcctcccaagtagctgggactacaggcgccggcccgccaccatgtcctgctaattttttttttttttcttgagacacagtcttgctctgtcgccaaggctggtgtgcagtggcgtgatcttggctgactgcaacctctgcctcccaggttgaagtgattcttgtgcttcagcctccccagtagctgggattacatgggattacaggtgcacaccacaaaggccggctagtttttctgtttttgagatggagtcttgctctgtcacccaggctggagtgcagtggcatgatcatggctcactgcaacctccacctcatgggttcaagcgattctcctgcctcagcctccagagtaactgggattacaggcgcctgccaccacgcccgtctaatttttatatttttagtagagacggggttttggcatgttggccaggctggtctcgaactcctgacctcgggtgatccgcccgcctcgccctcccaaagtgttgggattacaggtgtaagccaccgcacccagcccattttattaagcatgtctagaaagacttctaaatgatgctgattaatgctgtatcaaaaatattaggtaaccttacatgcaagaatcattttaagtaaacgtggttagcttgcagaaaggctgcctaaacaagggttaccaataatgatggctaatgctagattgtataccacgggccaaacattaaactaagctgtttacatgccttacttagttcatttaaccctgtacttgtaaggaagtaccattagtagtctttaaaacaacaacaacaaaaaaacacctgcagaatttgaagctgacagatgaaggtaacttgttcagtgttgggcagctagttaatggctgagccaggaattgaatctagactactggaataatagtcatgggctatatttttaggatttgaaaagatggaaatagcattactttgtttacaacaatctggggaccaaactccttgagcctgctaaaatgaagactgggatcaagtatgcttgaaatagtaatcttaaagaattcattttgggtggctttgtcttgggtattttgttgaacccagttaccttgatcattttttttctttttttgagacagcctctctcttgcccagcctggagtgcagtggtgcaatcttggctcactgcaacctccgcctcctgggttcaagtgattctcctgcctcagcctctggagtaccttgggactatgggcgtgcaccaccacgcctggctgatttttgtatttttagtagagacggggtttcaccatgttggccaggctggtctcaaactcctaacctcaggatccgctcacctcggcctcccaaagtgctgggattacaggcgtgagccaccattcctggcctgataaattgttttctagctggtttctgatcacttatgttctagctggtcattatgtattatttcatgaaagataggctctgtttagatatttaagaaccttatttttaaaaataaaacctgctttattttatcctgtgttcctcattggttggtctgtcaattggctaaagatacatatggcaatttattccttatttctgtatacaagtgggaatctattaacaaatgatcttggttgtaataaagggaagattaatttggcattttcagttttgtatttgggttttggaaacatcaagcaccttttagggtattgaagagagagcaccggatttggagtcaggagatttcagtcaaattttggattaaccatttacactccgactgtgggcacgaaaaacggcaaacacatcttttgttttctcccccaaacttgtcctcccagatgcttgaatctaaaacctagaatttaagggcactagtgatttttcatttttcctcactctctgtacttcacacccctaacaatccattaacaagtcattttgacaaaccacatcttggatttgcctctttttttcattgctgtttattttttatatagcagccatcttaaaatgtaaatcagatgagtgactcacccaagcaaaaaccctgcaagggtttctcaaccgagtaaaatcctgatcccttttgatgatctactagatgctatttcatctggtccattcctcctcctgctgccctatttcataccctcaactccttgatcacgttgtctcaaccttcttattggtctttctgtcctgaatttgctaagtttgtgtcctctgcctagtatggtcttccctctgtgaatctttgcagtgttccctgtctttaggcccaaatgttacctccttaaagagggcccaaggatccacctaagtaagtagtccccctgcccacctcctctgcatgttaacttgtacttttcccccccctccaatgtggcacttgccactatttgattttttccttgttttctgtcttcccctctctgaaagcttcaagagagtagggagcttaagtcttaacttaaaatgctgtattcccaacgttagaatagtagtgcctggcatgtaaggcacttatctcaagttatctggaaagtttagggttctctgtatttgaaagatgggattaatatgtagctcatgagattatcaggatcaaatatgacattattttatttactttaagtcacctagcacagttcttggcacatggttggtatttagatgtttagtttactatgatttgttgctgataactgttctcgatttggtttttggaaggcagggaccacttacatagatacatttcctatagtaattagcattgtgctttgtatatagactttcattttttaaaaattagttgaactaatcagtctttgatactgacttatttattgtgtgttacattttgtgtattatttgagttattggtgtggatacttgaatatatttatagattgtgaacaggaatgtatatccactggtctaacagcctgtattccctgttctgtcagttttttatatctagtgtttattttctttgaacttcaaaataccatgacggagtaaagagatctggcagttgggtcttctctggatatatatatatatatatatatatatatacacacacacacacatatatatgtatatatatatataaattagccttttggaattgtttagggaagtgttagctaaaatgagccttgtaccacttctaggagtgaatcagtagtaatgactttccaggtcagaatagttttatgacagtactccagtttagaagattgccatttttttctctggccacttggggttttgatattttaaaaactaaacttatatgtcctttagaaatcctttgtttttgtacccaatcttgcttggctttttgactttgctacttttttagtgtttcccttaataggttccgattcctccttcctaggctgaacctcaaatctctccccagttggagggccatggatattttaggagacgctattcttgattcaccagtttaatgttaccatttcttctttgtatttccagtctcgttttatttttaaaattggatcttggtaagagttacagatttccatttaaacttgttcatgaattctttgagtgctgatgtatattaatcttgtattccttagtttctgttcgcctggtgcttttgactatcctttgcacatacttgatgtgaatatacataaagctaaacttttcagtattggtaacttgaatattttgtgcaaagtttatttacagattaatgataaattattttaggaagaatattgactttcagtagataaaagtttcattgctgactgttcttttatttgaatgtagacgtatcaagatgcttttaggcacagaatttaaagttactatgatggctgttaacgtggatttaaaaatcagtttcacatgaaactaaattgtgtgaaaggaagtaccaaaagagaataagtagcagagcattaaactcatattttagatgttataaagtagagcattatgaaaattaactacagattaccttttttttttttttttttttttttttgagatggggtcgtgctgtgttgccaaggctagagtgtgttgccaaggctagtcacaggtgtgatcacagtgcattgcagtgtcaaactcctgggctcaagtgatccttctgcatcagcctcccaagtagctgggactacaggcttgtgctaccttgccccgctaccaagatggcattatgttagctacgttggaattttctgatggaacgacatatcatatgttttttaaggctcaaattactaaaattagaattcaagtagttaaaaagatgctgtcagtttcatgatacgctactgcattgtggtttacaaaaaagttgaattttaagcttttacggttaaaagtttcctatttcctgaattagtttttccttccctgaaattgtaagtgcgtttattagagtttatggcagtgcccattatatgcattgtaaataatggttatttaatttaacataaatcacaataatggtttttttgtctttgctaggaattcgaatttagagtttaatttctcagagcattctctccaggaagaatttttacagtatctcaaagacttcacttgacttcttgatcctgcataaaaccaaggtaaaagagcattcatttttctagttttcacttttgacttttttgaggaaatgtcactactgaattgatgattcagatggagtgattaaaaatgatgtggtccgaagctttgttttttgtttattttggtggcttgtatgaagtaagtcagatgttaagttagttttaggaaaaaggttctttttctgtcttcttccaggttgtgctcctgctttttctatttctataaacacatctactaaaagactcaggacatacaagatagaaagactgctacttaacccatttccctaatgtaaacaagaggagattcataacttgtttctctctactgtagtgtttaggtaattcaaattgattgctaatgtgttagatgtattaagtgaattaagttcatcaactcattaagtccactacaagtctgtgaagtaggtactgttattttcttcgttttacagttgaggaacaggctcagagagcttaaggaatttgaattcatgtagtttaaatgcagagaccatgttcttagctttttccctgtttttgcagtagagcagaagatatcaatccatttcttttggactgctaactatttgataggcatgctttctttccgttagtttttgaagtttcaggtgtagcttaaagcaaaacgcaaacctttaaaaatgaacttgctgctttaaaaaatgtccaggttctggggaatgcattcattttatagttatttattaaatacctgttgtgctcgtgtgccacaagcccagctacatcctggtgactgaaaaagcctacagaattcctgaatcctttaacagaaattaccatccaaaaagcctcaagagcaaagaacagagattctggagatacagcacaacacagcatctgtagctcttagtaaaatagtgttttatttactgattagtacaatgaaaaaggatgttgtcttattgctggactggatctccaaaatcatttgcagctctggtttctttttatagtgtgtctgattatctcagagtgggataaaaataaatatcttgaagtaaattcgatcagaatgaatgtaaattacgtatttatattcttttaaaaactttgggagggacagaattttgaaatcagatgcaagagaatgtcacagttccccgtggccaagattccttcctttacaggctgtaaatgtggtttttgccaatttcattatgttgtcaaaactacagttgctaaaccaaatttgtgttctacaaggtgtcagatctccttatgttaatgctaaatttatttcttatgtgttgtggaattcttactttgcctttttgaaccctgaacctatgttttgtttctgtctttatgtatttcttgcttacttgggattgagaagaagagtgagagaagacaaaggtggtagtctattagaggatagttatgttttattttgaaataagcatttatctcaaacatcttgaatttgttatttatattgcttgatgaggaactatccaagtattaccattacttcttctataactgaactcatcttagtacctccaaatactattttattataccgaacaaagtctaggtaggtaaaaaagtgccttcaaaaatacttggttgtaggagatactatttaagtattatgggaattgcaaggtgttagaagtttagtaagttgatttttattgaaatgaatactttttgagtaagttagtgtaaatttggaaatagttctatgcagcaaaaacaagcttgagaggctaagatataatctaatcattgaaaagttgaaaatgtgacatttgggatatgcatgcagtgatttgctatatgtgtatgttttttcaattagtagatcttataaatcaattagttttgacagttactgatttctgtacccaatgaggtctaattatagcattggataccatgtagtgtttagaaaagttaaactactggtgcccaagttttttttttcttgtagttctaataaatctttcttgaagtaatccctccaattctttatcttttattctttttaaatcttcttaacagaaagcttcagggtgaactaggcattgtcacataagtccactttattctggagtcatgagtactgagagcagagccatggctccagctgtttagaaacttagtgtcctgtattgttctaggatactatctagtaccactccagacaggattgtgtatatggagtggtcagttcagtctcattttcaaggccataaagcactatgataacagcctggtaggtttattttttgttagtattgtgacactttattttatttcagttgccttatctgtagtacctttattatttatctttcttacaggaggggtaggcatttgtattgggcgtggaataacacataacatgctgctgcagtctcattgctttttctggcttctgcagctgctgccttttaggattgaggctcataagtggggcagtccgtaaaaatcttcagttgtgtctttaatcgacagtacctgtcatgcaggtgaaaacagttttagtcagggataattgacttgtcttctgaatactgatttgaaaaggatggtgaataatagcctttgagaaacttgtaaaaatcaaattttatctgaaaataagtaataatgtaaaattttaaatatcatattgtaattttaacctttttttgccctatcatttgattaggagaaaagaaatgggtcgctccaattctagatcacattcttcaaggtcaaagtctagatcacagtctagttctcgatcaagatcaagatctcattctagaaagaagcgatacaggtgatttaatgtgctttaaatttttaaaataattatatcagttaatacttgttgaatgagtatcgtaaacacagtgctaaaccccaaaatgtattttattctcaaagaaccctgtgaaatggatctattgttatccttattgtaagcgagaaaatgagaatgtccaggtaacaagctctagtaaatggcagagcttggattgaaatccagttagtctgactccaggtctcaaattttactgtataatgtatggtaggtttctttgtatttgtccacaatgttaagagatgaattgggtaatgcaagaatttgacagtaaacaatctctgcatattgttttatagtttctcatttctgactgtgaatctttgaattctaacaaaataattttttttgttaaaaaaattaacaactctggttatttttgttaaaatagtaatacatacttagcatagaaaacagaaaccagaagttgaaaatacaaatgaccataataccattaagaattaatagtagttgatgctcattctttttcccccaccaggcttaactttatattatgtatgtatttaattaatagtatctcactgatagttttttgtaatcttttcccccatttaactatatattatgccatgccattaaatattcttttacaacatcaatttaagtgcttgcctagaggtactacaatttgctaatatgtcctaatgcatgtgatatatataacacatgcgtgtgtgtgtgtgtgtgtgtgtgtgtgtgtgttttgtgccttcatttgtaaggtctttaaggtattctctcagtatttaccttagtgaggctttttgattggaaaccattaacttttgtacagatgagttttttaaaaaagtgtatttttgcctttactgtttatttacatgttatattcaaccagagtatttagaatggtagcatggaatactttatttttcttgcattgatatttatttcatttttagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggtaaaaactaaaatacagaatctagattataatattgtttttgttctttgaattctgtttggaattataaacgtaaaattgtgatatgtatttaactagcggtttttactcttgacttccttcattttaagataattccaaattgtttttactcttatctggtgaactttggaagctaagtgttttaataaaaattaatttatccagctactcaggaggctgaggcgggaggatctcttgagcccaggagttcaaggctgtggtgagctatgattgcgcctactgcactccagcctgggcgatagagcaagaccctgtctctttaaaaagaattaaaaaaacctaatttctatccctcctcttaattttaccattttcggtccagaattaaaaatacagatgaggagaagttgagtagcttagagcataactaaatgatatatgttgctaataactgtaaaccttttagaaattaagtttcttaaagcattgaaggcttattttgttcttttcactattagaatgtgacctacataaataatgcagctatattgcatgttcttaggtggcataaacagtctggctgtcaatatttaatgatttcagcctgactatacaaaaggtaatggtatttctcactgactaatgacatttgaaacagatacattgtttaaattctgatttcaagtgttgctgaaagttgctaacagtgaaaattggttgcttcatgtattgtgatttgacttaaaagtgagaaaatagaggaaacatgctgtttgtggaatagcactgcacaatctagaatttatgattgaactgatcattagtttctatgaaatagtgccagaaatcattatttttctagagcaagtttatatgaactgttctgtgattttcataaagtattaaattactgcagtggtaattaaatccatttgtgtgaactcttgtttatattaatagataatatctggaattttggggataattatcaatagaattctaacaatgtattatctattagtggttcttagtttcaaaaattaaatttaggcaatctctagaagttcgtgttagtgcagaattgtggattgtgactaaataggacaggtttttgtgattggctttgtgttttaaacttcagaagtcaaatgtaaatttattttaaaagtcagtacataagttctatatggatgctttcaatgatttttaaaagtggaatctgaaaaagcacttttcaatagggttattttctctcttgctggtcctgagggattgggcaacacatttaaatatggaagcgatctacagtgaatgcaatccagagttactatcctcttctttgcttattcgcaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacaggtaattccatattgatgcccagtaaataatctgtgggcagtcagtattccagttaattatcttaaactttctgaacataccatttttatatttaaaccaatggtatattttgtgtgtgtgtgtgttatcaatatgttccagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaaggtatgcttagtatgtttagtatcgtgaattaaatttctcttgcatgcaaataaaaaaatgtgtaattatgcttaataattcatgtaccccagggctagcaaatatacatccaatattattaaaacttggaaaagtagtttcatagaagagagtccctagtcttgctagcattgaaacttatgaagatagttaataaaaagtaattgaaatgctggagaaaccatatgctaaaaatctgtatcatggtagaacatgatgtagatttgttgaatgctaaaagtgttttttaagtatgtcattgtaatgtacttgaagtgcagaaggcttacagatagtctttcattgcatgcctatggcttgtgataatcttggcatagatttataacaaagtcagacagtattgttattgaatatttctaagaatttcttttcaacttttaaagaaatctgaaatggtggaaaaacactttttttgcgcttaattttttatacataaaaatcttaaaatgataaaacaagaaaatttatcaggatttttaaaggaaaaacgttcaagaaatttagaagtatattatataaatactgattacatgaatagtgactaattaggataatgatgacacttctttaggtcctaaagataaggttgtttatttcaactaaagtaatgatttttttttttaaatttttaccagtatgtaattatagttgcagagttactaataattttcaaagattttcaagtatgtcttttgggcagttaggttaagttttgtttttgttgttttgtttctgtgtttaaaaagcaacttactatgagacatattctttctcaggaacttcaaagactgttggcctttaaaattaatcccctccccgcttttaaaaaatctgtcgtttgacatgagaacagctcaatgtaatagatgaaacttgcctctagcagttctttatgcagttgatacatcagaacagtgaatagttagatgaatttcttttgggctgtaattatttaaacacggtaacaagacagttttgctatttggctctgagtaggtttgtgaaccagtttatgaccatattactgtggtacataaaatatgaaacattcttttttttttaattttttaatcttttttggcctagctccacattttacaatttattactgaattttgagatcaggttttgataaattttttcctttttcttttttctttttttttttttaaaagaactgtagtaatgtttcataattggtattgtgcaaccgatctgaacagctcttactttatatagagctgaaaatgcccagtgatgttttctttttcattgtaactaggtcctggaatatgttttgaaatggcaaaatccatgtttcaaagtaaaatagctgttgaaagatacaggcaaagttgaatcttctgtcttcctggcaaaaatggcataaaaactgagttgctagctcaaattcctgggtttcatggaattatgattgaggcactacccttgtagtggccgtttcaagttttaatgattggttatgagacatgtgctggatattgggcggtaagttgacaacagatgtatgttgacctgttaagcagatagcttgcttcataatgtgacatttcatagctcatgactttatacgtctttctattttacatttacaacatatcttgaactggttttaaaaataatcagtattgatattactagtttgaaaattgtttaaagagagacaaaacagcaatatcaaatttgctgttgggtttgccaagatgccagatttttggagtaattattgaatgttaattgatttaaaaatatttttccaatttgggtgataatattcagtgtttttataaatccatttttgttgatatggcagcatatagtcactgatgaaatttaatagttgacccaaacaagctttttagttaactccatattttcctgttttttgttttctgcaaatgattacttgaagtaatgtcattggttcatattggcaaggtattagagcatccatagattatgttcctttttgttctgaggaagtagtgtattaatgaagtggaattagagactcttgatttaatctattaattgctcttggattagatgtagtattgacagggacctgtgagcaactttcgaaacactctcctgttgaggtacaagaaattgaaagggtaggagttccttgtaacacttgattctcttttgctaggtttcttatttttattttcttttcacctgctacatgcccttctgtcacaaacaaatctctcttaaagtaaagttaactaatcggacagtatttcttctaaatcaacagagcaatacttcaagtcagctgcaatgaccctaaacgagcggttcacttcgtatcagaaagccactgaagaacatagtactcggcaaaagagccctgaaatacacaggtatgtatcctgctgaactggcatataaaaacgttgttttgataggaagacactgttaaaacaagattgtattggaagtttgtttttgtcattgatacaagtattattcctcatttatactttaaataaatatatttcaaagtcttgaaaattctataattcttgattttcagcttagttgaaactggttgttagaacttgaaatattaactcttattactttgcagtatggaattaaatagttatcaattagtttggtttttgggaggggcagtggaggcctagagttaccttcgaatttctagtgaaataaatgtgaaataaatgtttggtgagagagagagaacgaaagcatgagcattgaagtcagatagttgtgttgaaatcctgactttgtctcttcgttgcattgtgatgaacaacttaatctctggacgtaagttttttcatatacaaaatgtggataatcatgccagttttgcagggtggcagtgacagtgatattggctatgaagtatctgacttggtactttgtacacagttggtgtgattttggtgatgactgctaaagaagcactgggtagttgcagccaatactgacttagaaaggaaaggtgcagaataaaactaaaggggcactgaatatctaaaaatactgaagacaggagcaaataatcctattcatgtgtgtttgttgatgcttaaaatcatatccagtttaatcaaaacacattttttctatttttgatggctaaaataagtttgatgttttaaaggccagacttcacttctatataaaaatatctggttggagcattttaattcattctttgtgggtattttttcttaattgtgtattataaactaaattaatagtcttggtgtgctaaattagttgattgggagagaaataactgtcttaggaaaatggataatcgtgtggatgtttttgaaccaaaaagttaataatatgactaaaaatatattttattttacattaaggagaattgacatctcaccaagtaccctgaggaagcatacccgtttagcaggggaagagagagtttttaaagaagaaaatcaaaaggtatgtttttgaatgtaattttttttcgtgttaagttcagcttagttaatgatattgtaccaaatatagtttctcaaggcaaaatgtctatagatatcttctacttttaattcataactatattatggtagtgtacatactgtttcttcctggaagaaattaaggtgacactatactaagtgtcttaaatttaaaccaagagtgttttttcaaaacactaatgaaaggaaaaaaaatagtcctaagaaaagtgtaaagaatcagtgggtagacaaagggaaattataaaatcaaagatacaaattagaattttgagatgagattcattagccagagtaaatatttctcgatttgtgtgtctaaattaatatctctaggttcttcacagataacaagaagtaatccccatgctactgagcatttttgatgtggattaagaaataagcattctaagaactggtttacaaatgaacgtttggaacaaagacttgtcactcttggaatgtttggggattgggggaatgtcttttaaacatgagagaggagcctgtgaaagatattgaggggtcttggtgagaatggaattcagtggttaaggggtctccaatatactcttgacaattcaaaatgacctttgccaggtagactaatctatatcaggccataaaatgtctagtagtagaaatgtggggaaaggcagaaagggagcaactgttttgaagagattaggggacttggaagtactgcttggttccaattctggctgtcactaagtactatctacatgatatttggaaaataacctcttgaaccttgcttttctaattagaaaaatgagaatgcatctgttttgcagagttgttgaataattgggttattttgaaaataggcacgtttgttactagaagctgttatggacagtggtagtatacaagtttaatagggcatgctattaacttactagatgtggaatctagagcttacaaacaaggtttttttttgttctgttattttttttgtttttgttttgcatggggcgtattgatgttgaaagaacagattctgagtagtgaatactttttttggtttttaacttaaataatatcttgggttcaaagttgttaatttagttttcccaacagtttagtctgtcctcgtgctctgacagtgagtatcttctctcctcattacatagaccagattttgatccagaggagaaaaagtagagataattgatgaatagacaagaggatatgccattggtttttatcctcctgtctggatgaataacatgttaatatgtaattatgtatatatcgtttgtaatttacaaagtagtttcatttacattatcttgttacttgtggacttggtaatacctaggtgaataggaaggtttttttgctcttgattagatttttttctttgtgactctgggagcaaataggtgagtagttgatatcatttggagatacgtactttcagttttatgaatgcttatgaatattatagccagacttcccagagtaaatactacttattgttgaatactagcaaggatgtccacattgcttagcatcttactgatgtataatttctcttcattcctagatgcctctttccatcttcctaaattatatagtatttgaaaaagcaatggaacaagaaggaggtgaattgtgacccagttaaactaatgtccgttgcaatacctgaattgagaaagggcagtatatggcccaagatactgagtacaggattgcgaatatctttctggctttgtttctacccttgttcaaccaattggtttcattaataatattttacgtgcatgttatggaaattatagaattcttacttctgaagtttttttttttattgggttggtcagattatttgggaagagcttgatcataatgaggcttaagtaatgagaaccattatgttaggatctcttttatttaggtagaaggctacattacaactacagattataacatctgtcattgttcaactattgaaaacagcatttggaaggatgagggataataaggatgtgctgagtggaaaaaatatttgtatcatttactgtacaaaaatttattatagattgttttggataaaaacctgcaaaattctcaagataattagcttttaataatttccccagtcccactgcactttgtatacacaaatgtttagtaaaaatagtcaagtacattttttaacaaaaactaagtgatagtatcttatatgattcattattttctgatactaaaatgccagtttagaagctggcataaaatttaactctataatatgtgtatatatattttttctatttctcccctgaaatctgtattttatatctgtcttttatagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacaggtaattgttcaaactgactaagataggttttagcttctaattagcctttaataattgtcagcttaattgctttcaattttgactgtgtaatcgaatgtttaaatttaaacaattaaaattatttgttttacagcaaaaatgtatttgtcttttacacggcttatggtggatgaggacaaaaactttggaatagcaagctaacactgaaaaaaaaaatgacaaattaatgtgtcctattatccaggctacatcaggaggttggacttcaatgcagtgcatttctagaaacagtttgtgtaagaactttggttcgttatgcttgattccgcactttttcaactcataacacccagagtacaagaattttaaactgatatctagtggtttaacatgggagagatgggggggaggaaggactagaaatagcaatgtgtattagtctttcaaaataatatttccttggaaactgttagcagtggtaagagttaaccacaggtatgaccttttcgggtgttgcattaaatcatgtaaatttgatcatcatagagtcaaataggaacacaaagtattatagataatctttttccttgctattcattaggtaaatggtggattttgtttgtgttattaaatttatggctgttatttgtaatgtcatatgctttttatttgctataatggtactatagcccaaactataccaactattttcacccagggtgtacaaactgcagtcattttgaaacttggccttaagaacatccttactttttcctactcttctcttcctttcattaaagtaataaaagacataacttaatttaaaaatactaaagaactgaaccttattcttgacctttacagactactattttctaactggcaggccctagcatgtttttcattattgatgtaaaacacatattgaaggagaatggaaacagactgtgtcaaagtttaacacccaattattttatttacataattttattaggggatagtgttgttgacttgaaaaatatctcttctgttgtaagattcagcagggtctttatctttttaaaagtatcacattttttgttttctttattttgcagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttgtaagtgaaaaaattatctttgattgtttggtaggagtttatcttagagtactgtacataaggaaggtcatatacatgatttagagattgttatgtgtgtcattattcctaaagtcagagatagtattgaaacatgaagtggtgtttgaagtgctgtcttcatttagaaatgccattttgaggtctagaagcatctgtataaactaggtacttttcttgacttcgagatcaataactgtacctagtccttaaagaccaagagtcaaggaaagttactgatttgtaataacatttctttaatcacttagtttttgaaaaggtaccttaacgccttaataaaacccctgtatgttcatctctgtattacagttacattcattttgcctgctttcttcaaatccttgcttatatgggtatcaatcatagaaatcatataaatatttcacatagcatatacattatccccatgtttctgtaagtcgttataattattaatataatgacttccatggtagtgcatcttcttgcctgtttaatttcaagattcacactcctaccttgagcgagtatctagttgggttttggtggagttcatttattagataatttgggaaagagaagagctttgcttgtatggtgataggtatggctgaatacttggggcttctatgataattcaaagaaattagacaacttttgactagtaaaaaggaaaaacaacttgattatttaaaaatattagttcagtccatgaaagtacagtattctaacacttaggttgatcatttcttaacctactcaacttttagttggcagaaattttttgcctatgatataaaatggccatccttttcatcctcaatggccatgagatttagataggaaattagggcatatgttttttgttactgcagtaaaattagaatttgcatgtaactaaataccttttgattgcatcactaaacaactttgttaatgttaatcagtttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttggtgggtgttagacatctgtgtttatttggtttgcattaattttcgaagcatactaggtgaataaatttgagtacagataaccactactataagaagattcaccgttatgtgggaaaccttttttaaaataattacccagacgatttgaaattttgaaaaatgtgggtccctttagtcctgttcatactttcttgatattaaacataggctgatcagggtaagcaaaaaatatacctgatttgttacccacattcagagaaaaacattatattatagttgagcttaatgtttgttttatatctgtctataagacagtgacagttgtagaaacttcacattaagatgtaccttccattatcatagctatttgtttaaatgaaaaggagaataattttttcaaagtacgtgtaattaagaattttagggaggctgtcaactttcattggagaaaaaagatgatgaaaaattacattacagaaaagttgctgctagatacactaatttggtgcttcctgtggtagaggtgcttttccctctgaaatagtttttcaaggatgaagctagaggtggtaggtcctgaaggattctctagataaggatgggcattttctgctgtttggcatggggaaaagggtctctcctgcattatagaggtggacaagaatataccgaaactattaccagaagtattcatttttttgtcatggcttttcagagaatttatgcttcagagactagttctgaaaactagttccttccatggaggaagattgtattggacttgaggaattgttgactttttcagttggctttttatgagtatatttgaataaacctgaatgtccatgacatacctacttagaggttatagctatagtttgaagtggatctctattttgtctggaaaaactatatatgtttcaaaaatatatttccatttgcctcttttttggcatgttaatgaccaagaaccaaaaaaaaaaagttacagagtgcgttatgcataatgttttctcagtttatgcttcttgagtgtcttgaattgacattctggaaagtaaaaggcatttgatgtatagaaaaatttgaaagatccatctacttggttcaagaatttatgtattaacagacatgtttatgctaggtactaaggatggaaagacaagtaggatgtgattctaatttttgacttagagactgctagtagtagagaaacaaacattctaaatatatatggtggcttttcacttttcccaaagaagaaataggtggatttctgcaaaggagacagtgattaggagagacttttgtagaggaacttgaccttaatcttgaggttaagaggtaggcaagtgtactgcacatagcagaaggagtgaaacagcatggtatagataactctagtactcagatggctagatggttggtataagtgtgggaaaattgagtacaaggagtcagtgtgaaaggtcttaatacttttaagaaaatagagttttaagcagagtttacaaaaatcatgggtgttaaaagttaagcaatttgagagaatatagtgtctgaactaaggggctagatttgagaaagtaacatttatggggacttgaattcagggagttggtagtgagaggaaggaatctaaatctgtaggaaagaagctcctttcaaaagattaagttctgttctgaacaggttgaatttgaagtgcctgggagaaatggagctgtccagtggatagttggtaattcagatttagagaaacaaaaaaatctaagtgctctaattttataggtcaccattaaagctgtgttaagatcacagaagagacgagataaagaccaacatttcaaaggtggggtgaaaagtgagagagagtaaaaatgccagagaagtagaccaggtatgatagataggtcagaaggttaagagggaatgaggggtgaacaaatagatagtaattgtttaacacttttaacaatttacaaatattaaatttaggccgtttttctatggcattctcttgagtctgctaacccttaacaagtacatactcattttgggttggcgtttacttaggcagtagtttcattaagaactgtcttattttaagaatttagccacttataagtagcagtaatatttttacatgttgcttttctgggttatatttaaaaatcttggtctctataaaacataaacattgatttgccacagactgatgatgctcactagaatatcaagcaaaattacacactttttccttataaattagttcccaaagttaattattttggtttttacttatgagccattgaaatggcaactttggttttcacatgaatagttaaatttaaaagattttgtatcttatatgtaaaggaatgttgagggaaaagaaggaaaaatatgattcagaagaaaagtctagaactagacattcattcccttaggttctttcagaacaattaaccagtttaaaagagtttgcacatttggatgaaacattaatacttagtaactaacaggccaggcacggtggctcacacctgtaatcccagcactttgggaggctgagacaggtggatcatgaggtcaggagttcaagaacagcctggccaacatgttgaaaccctgtctctacaaaaaaaacgaaaattagctgagcgtggtggtgcgtgcctgtagtcccaactactcgggaggctgaggcaggagaatcgcttgaacccaagtggtggaggttgcagtgagccaaggttgcgccattatactccagcctgtgtgacagagtgagaatctgtctcaaacaaacaaaaaagcttagtaataatagataacatttgttaagcatcatgtactatgctaggtgctgttctgagtgttctgtatgtatgaatacttaaaaaaggcttttgagttggggccattattctatttttgtggatggaaaaaactgaggtacaaaggtggagtagcttaagcagagttatgtggctagtgcaatggggtcaggatttatgcattgggctccagagtcagggttctgaaagtcttgtttgtactatttgttgtccaatactgagttatagtaatctttgttgcattctttttgaattttcctatctctaagctttgttttatgcaaaggtgtggtaatgttttcaataataaaaattccaggaaagatactagttttagttagaacctgaaattctatggaggggtgagtgtgaagagttggagcaagtgggaaagtactgaagtaggcagattctcagtgttgagttgctgtcttcaaaggaagagaaaatcgttggtggggaagggggttcaggattggagttttggttattattcctttgaaacgtgatccttgtatggagaagagaagatgattcagaaggtcttggtttctaatacagactcctttgttaacatgttcttagctgtgtataaatatctaacttctggcccttttaaatctgagataattaaaaattaaacattttaataatgagactgaaatcttcgatataaaacttgagtattaagaatatgtttagcatcaaaaatctcaattaagtagctgccaggatgccctacgaaaggcacagtttaattgtttaggtgctgttgtgtttaccaagtttcagatgattgtatattaaaagcaatggctagtttaaccctagtgtctagctttgctcttggcttttctatttctgctaactcttagctacctggtgtggtaatcatatactgccaccaagatatctgggaaatgtgttttatgggtgatggtcacaaggggtagaagaaagggctagctctgtgaccttgggcaagttacttaatttctcagtgcctcagtttgtttatttctaaagtgagggcagtaatactatcttagagggttgttgtgaggattagttgaataaatacatgtgaagtgttcagaacagggccagatccatattacacactatagaaacatcatttttgccaccatttattgagtgcttgcttgtcagacactgggccgggcacttcctgctgatctgtgttccctcaaggcacacattattaaaatgaagtgaattctagagaggttgcccaaagtcacacagtttctgataagatttaaacccatgcttctactccaaaacctcttcccagaatccatggtgtattgtgtaaaaatcataaaaaaacacagcctctggagttgggtatgttaatgtgataagggagcatgaaattatgtagtggagtgggcattatttttagtggcagactattttaaagtagtttattttgggtttgtaataaactctgccgtatttaaatttacacttttgatagttccaaaattcattcattatagagtcatgtacacctctacctagtaatctttcagtggtttggtaaagatagattattagcagttggtaagttctctttcatatggtctgttagttacccatataattgaacttttcaagtcatgaagggggttaatcagttaaatgaatatatccaaaggcacagtcttatgttttggaaaaaaaatactcatatgccatattacgtaaaaaaaagttttagtggcttttggatggttgctcactactggtactctatagattacacaacattttgtttgcattataccccttttctaataaaggggcattttgctttatttcccatttttgtgggtgacaaagttaataagttagctgttaattaaattacatacaggactcccttggccttttgtatgaatataatacccatctctactcatctacaaagtcaagtacttttcagttttgcagattgttttgcttaatagaacaatttcataatttggggatcatctgtatttgaatacaattaatggttaaagctgggatgtgataactgcagtactttagattgatgaagaactgagtgagatgttaattctagggaccgtgtcatgatttaccattgaaattctctagcccagaacatcgatatgtactgtacattgatctagatttcaatctcagtagatttaaaatctacttttatatgtaaagtataaaattcataccaccagtttcattttagtgaatgttataatattttaatgatatttttatgactttctgctgcatctttatgactaaggtaattttgggaaaaacttaattttatctcattgcatttggtgtaataataagtggacttggattgacataataaaaaaacaaaactcaggattctaaaaatcagtggtaatttagcagttgagatcttccaaatgattgtctgggtaaccttcagtgcttgggttgctaagtagtaagatgtagttattctcttgatgatggaatgtatttttgttgaaaaattcagttttactggttttgttttattgtgttttagaatattaccaatctcatatacccaatcttcagaagattaatactgtgatttatgattggagaaatgatcatctttacaagaaacatttcattgacaattgtttttaacctttctgtagcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggtataaaatttcaacttgtgattctgacagattttttttgatataggtttggtgggtgaattatttcatttttaggaacaattattaatatggttccttttcactctccgcatcttttgttaatctttaattttttctctctcttttaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaataactgctgttgtttgtttacctgtgtctatttcacacatcttatttctgtggcctattttagaatatcagcgcatctgttaggaagattactggtgtggtaaggcttgataaatgctttataaactccctcaaacctttctttactgtttttttgttttgtcttgtttttgtttttgtttttgtttttgtttttgtttttgtttttcccttgtctcccctgggaaaatgggaaattttacagttggtaaatctaagccaaaattattttgaaataaaggaattctggatgtccagtttagtcctcgttttcttacgttaatctgggaccttatcacccataatatggtgattacttctctttctaaaaacatagtagctagtaaataagtaaaaagaattgtcttttcattcactttaagtaagatgtggtataattcttaccatgtgccatcctgtcagttttaacaaagcattttcacagaaatttgtgtactaagacaaactgacacattttgactcatacaaatggcaaattagtccttaaaaattctgtgagagaaataactctgtgtgtacatacatatgcatgtaaagtgttgtgtaagatcattggtagcttaattatactggataattgtaatgttatatacaaatttcttatataaaagtatgctgcattattaacatttgtttaacttttcttatttttctttttctgggtttcaactggaatcccattggtggggatgtaccttaagtttccttgtggaataatagactttcacatccagaaagagaagttcagaggcctttctcaatttacagagttgaagaggaaaggcaaatggaggaataaacttcattgtcattgggattaatttggctagactcaatctcttgagccttaaaatgagaaagtaatatccattacatgtttagagttctcaaatagttgatactattattaaatgtttcaaattttattggggtagatactaaaaattagtacactgtcctaatgaagtttaaatgaacaagttttacatttcttaggattcaggaatatatggaatctagttgtatttaattgacttgagagccacagagattgtgttgatttatgagctggactcctattgttttagaaacatgcagtaatgattaacttgtgtcaatgatggtaatgagaccaaacttgtacatttaattaagggtaccagttctttttatgttactagactataccttggcctttaaaaatgaatctcactgattaaagagaacaggcattattaggatagcattccaccacaactagaaacattcaaataatgtgtcttaattgtaatctgtatataggaaaatttttcctatggatatttttggtgttttaccacagtgaactgatttgtagcacttatgaagtgcagaaggtaatattcttgaaaatagaaaaaggttgggtgagcaggctttaatgcctttcccccaagaatatacatcgaatttttcttaatcttttggggttggccagcttccagatttcattaataatgagctctgcctttaataaaagtacatgatcatagctacactgtatgtttaggtggtgtgaaatgatttataatcacagcttgaactgtgtttgcttggtactgtcatagtgattacaaatttcatggaatgcgaagagcaacaataaataaaaaataccactcaccctccagaatagtggattatttgctaccttgagtccttcactatggaaaataatttttcagtctcatttgtactagaagggaaaactaaactttctgttgagttctcaggatacttgtaaggtggccgtgaaaaagaatgttaaatgcactttgaattatttatttatttatttatttatttatttatttatttattgagatggagtcttacccagactagagtgcagtggctcgagctc

SEQ ID NO: 4 - DNA, 59132 bp, Homo sapiens
ctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggtgagcgagccggagccccagcagccgcggagtcccagccgccgcggagccccggccacctgtccccctatcctccgaccccggggcctggtccttcgccaggatctggtgctgtcacctctagaggagcgctttcgaggggcttcgaggtccccaggctgcgttccccggcgctctgggtgccctcttaggtttgcgtcctctgtctccccacacccggccggggcaggacagggccccgctttgcaccttcgtggctcggctgcacagcagtggccggccctgctccaggctcttctcaggcgcgcgctccaggctaccccgctttggaggccaagggccgggaggctgggaggccaggtggtgaccctcagctctccaggcccatgcaggcaacctaggctgggccggcgctcggggcgagagggagtatgtccctctgcccctggggacactattcccccggactcccaaggctgcttctcgaaccggcacccacagttccttccttcccactgcttctccactttcgttctccgtgggccgaaggagggattgggtttcctttcccgagaggtgcctgcggcctggaagctcccgcccagcccggccccaccgggagcccagggctacgcaccccgcaaggaggtgccctcgccccagcaggggcttagcgtttccggcggccggggagcgggtggcggcactggctttgggagcccacggccgggtggggagctggcctggaggaggcgcgtggaaggcgccacaggaaacccgacccctcctcgcggagagctggaatgggggatggagccggggcctcccagggtgcccagagcgtgcaggaaatgcagagattgaggggcgggggtctgcacccggtcagttgtctatcccaagccacctctggtttattgaattggatcacgccagctgctgacgccacttcccctgacgactccaactctgaaatctgagattgcagaatctgtgtttctgccagggtggccccccagtgccccgcggccaggcctgccccctctcccacccgctgcgcggccgccgggtggaggcgcagggacaggccggccttcccctgccaggcctggtggctgtttataaacaatgacttttgcttctgagacccgcgggctccctaaggatgcaaccacgtgattgctgggggatgggggagaggggggcgcctagagcttccccatacctccctcagagtcctactgctcatccctgtgtttcctggctaaggaggtgggtgggtgtgcattgaaggaagggccctcagccaagtccaggtttgcccagacccagctccccaaccccccaccccagggaaggaggaggaggaggaggaggaggaggaggaggagggattaaagccccaggaatagctggctgggggctgggaagacttcaggttgtggggtgggggggtggcagcacagatgcagccacccctgctccgggctgccatgactgggtaatccatctgtgtgcctggagcaggcagccctgggccagagcctgcttccttccctaaagggccagggagatgaatgggaagggaggttagctgagctgtgttccctgcccccttcccactggtgtcccaccccttcctggctccccaaggctcttggtgtgtctcctttgccctggttgtcttttctctgcagcagcatctttgatgtcattctcggggcagtaggcaagggctgtgtcccctccaaggaggtggtgatgtatcactgagctcctgagacaccatccctctctcttgagcccctgttctgtggccacgggcagttggctgacagttggtcagctaggcatgctggtcttggccaacagctgaccttgcccatgccgggcttcctgggactggagttgtttagtgttccagctgctctctgcctgccggagactagttagggaccctccccccatcagaaaccaaggcagcatgaccatcatgacaggcatccaggccaggtctctgaaagtagccttcccctccctttgggttgcaggccctgctcgcaggaagccccatgcctcaacccacagcagcctctgctgtgtgccttcctgtagagtctgtgccatcattggagggtcatcctcagtgtcttctgttggtgatcagtgccgcctctaactcccactgtcaatgaaactggaatcctagtctcttacaggcagccccaccactatacctaccttgccttggtgaaatcagtgggtaatagggcaattccagtttccctgtggctacaggaaggcgtttcctgagcaaggatggcaggagctgtgctgggaggctgggagagtcctggcgtcctggcgtaggaagaagggcccgtatcttgcatccacccttcacccccggccttcccacatccacttccagcccaaacaaacatccagactgtgagggtgacagtgtggtcaagggcagcctgcactcttgtagggtccccaagccagctcttttttgactgttgttacctgttgacccttctgcctccaccactggtctggctgatccctgagggcacggcagggcacatccaggtgtgtgcattgaggatgttacctggccccagtcggtgcttagtgaatgtttttgaacaagggatttgggcctgacgcaggctgatggtggattgatttgtgttgtttgttctctgccatcactcattcatcaaatcctgcctggacacaggcccagtgcctcctgggctgagtccccgatgctgtctcaggcagggtgcatgtgtctggcctgtctggagctttttcttgaaggtcccatggcctgtggccttggtgtgaggagggtatgagaataaattggaagggttgccagggcctccagcatggcaccattgctcctggccccctggccactgcccccggaatgcgtggggtgcactgtgtgtgctgggagcttgagcctgtgggcgccgtgaggtcatcttcccattgcgtttggcttgtcgaaccctctataaatgattgtgtccatttttgggcctcagaagagtggctaggcaaagccagtgtagggtggagcctgggtcagatgacggggaggattagaggttggcaggctgggcccctcgcgggatggggcgcctggggagaaggacagctgagggggtggggatctggcctgctggcccctgaaggcccacggcttgggagtcctcatggagccggcctgacggagctgggcctttctctgaccacgctgggctgacagtgagcacaggaggaaggctctggcagggtgggagtgtgcatgctgtccctccctcccggcaggtcctgagcatgctggaggggtgcaggctggatagtggggagggccagctgggcagagggagggcccagggttgtcagtgcccagcacagcgctgacatgccgagaagaggctcgctaaaggaaggtgcagtggtggcgattcctagagccttgatgcatggccatgaattgcactatgctcagctgcgtggtcaaggtctcctcacgcagtagccaccttagcctcctccggaggagccaggcctgtacaccaagcgttatatttgcagcaacctcagaagcagcaatgctacacctgagagtgggtgcatggtccctgtaatagaaaggacaatgggggcataggcaggcccagccacctgcccaagtcacccaggccctcagtgatggcactgggagcccacccagaggccctggtctcctcaccttggccactgactttgcaggggtcccgcccccttcccaggccctagcacaaagatgcccccctctacccacattcccatctctgtccatcttggggcccatctctgtccttctgtccttgaatgtctgaggttcttccctgccggctactgtcttgtctttttctctgtctctgtctgtacctccctgctctgggcctcttccctctgaacctgttcaggctcttcctgtatctctccagtctcagcttcccctggacccgagttacttatgtagatggttcatctcaccctgcagggaaggcttctgagctgggcatcttctgtgggtgggcccaggtgtgtgtgggttcttgggtgttcggtaaaggcgtgtgggcatgggaggttggaagcatggcttccagacttccccaatcccccaggggccctggatggcctgagtacagccttctggctcatgcagggaccaagccaggcacaggctacttgtccaggcacagcctacttgggaggctgcatggggcatggggaaggagaaggcattccaggaggtgcaggcatggtccaaggtgtggagagaggtgtgaggacattgaggatgccagctctctgaagagaaggggtgcctgggtggtagattccctccatatttcatgaagttgtgaaggccaggaagatctatggatcgcaaggattcttggagaagctgaggcttgaactctctgcgccctcttcaagatcaccacatcggggctcccttctcactggcatctgaccaggtccttgtccctggactcagcgtccagcccagctggtcccttacaagctgtgtgactgtccctgaggttctagaatccctgagtcctacccttggaggtaggccctctgtcctcatatctctgtaaggaacagcatgcacaggcgtgcacaggctctgggtttccctgacatgctgcggacccttcctgagccctgtttcttcatgtatcaaatagggaataagaacagttcctcttcacacatgtgttgtgggaagtaaagccccaggcaggtgcttggggcatagcaagtgctcattgaatgccagctctgtggcagagcggcaccttgagcccacatgtggcaccttcttcctgcatggccccgcttcctagcccctgtccccagagtgtccattacaggcctctatagacagctaatccctcctgagcctggggttgatcaggcttatgacgttcacagacccggggcagtgagtgtatgtgcatgcatgtgtgtgggtgcagtgtacaggggtggagggtttgggcttgggaatcagagagctttagagtgaatcttgactactcccaccataaactataagtttttttctgtctctgggcttaacttttcaccactggcatatgatgaagtttgtgtgttcattcctttattcatgcaacaaatattgagcaccaccatatactgggcactgttctagggagtggggacccaggagtcagcagaaccaagcccctgctctcctggagctgacattctcaccaggggagatggtgaagaaaccaccaagtatagtggcaggtgcttagaggggtggtgaggcagggactcacctgccctcaggactttctgcatgtgtcccgtgcgggaggagtgtgctaggttgaggattgagatgtggacgtgactgtgggagctcacacagcaagtggattgggtggagagagtcaggtgggcagctcccgtcccaggtgaggggcacccacgggaggatggcttccttttggatgccaccctggtttgttgtgttttcctaaagctgcctgtttggcaagcctccttttaggattaagagtgcagatgtgcagcctcgctgggtgtttgtgcagggcaggtgggcaggggtacctgtccaggatggaggatgggggaggcaggaggggctgctaaaggagaggaggagggtgtcaaagatggcctctgctgcccagggccacttgtaagattctcatgccaggcagcaactctgggtgcggtagaaagctctagacagctgagtttgagtctatccccaccccccgcacattcctacccttgggcaagtctcactgaattcttggaatcccggtttcctcatctgaaacaggggtcatgatctctgccgctggggctgtggtgaagacgaaatcgaaatgtgctggagaggctgcccactcaggtggggctccaggttctgctcctgcggagaccactggagggactcagcctactgctgttcttgtgctgtggaagaggcccagcacccgggcttctgagaggctgccacctcctaaagaggccgcagggttgtggacctgccaagggctgacaggggtcagggctggggagccgaggagagaaaggcaggctcttcctgctacagggaagcccttgtcaaatattaacttaaacataatggcattgtttcctgcatactggctgcatgccatcatcactgtggacaggtgagagtattatacgtcccatccacaaaggaagaaactgaagctggagtggttgtgtgactccccagtgggccgtctgggcttctacctcccttgtggtcagtaggatcagtagtggggtctggcctggggcaaggccttggagacaagcaaatgagatggaggcgtccagcggactccctgcataaagccctgatggtgaaggagtgtcattgtgacagactttggtccccaagaccctcccaagacttggggcccctgtcggacccccagctccacctggggtctaggcttgcactttggagtgtgtggtagactctggggtgatgggaacacctggggtttctaggtgcaagtccagagatgggggttcatgcacgcaaatgaggacagacaggaccctgtgctgtgtgttttttcccaaatagtaaaagttgtctccagtttattccagtctaaaagaacactcttggccgggtgcggtggctcatgcctgtaatccccagcactttgggaggccgagacgggtggatcccctgaagtcagcagttctagaccacagctggccaacatggtgaaaccccgtctctactaaaaatacaaaaattagcctggcgtggtggcggcgcttgtaatcccagctactcgggaggctgaggcagtagaatcgcttgaacctgcaaggcggaggttgcagtgagctgagatcacaccactgcactccggcctgggcgacagagcgagactccgtctcaaaaaaaaaaggccaggcgcagtggctcacgcctgtaaccccagcactttgggaggccgaggcgggcggatcacgaggtcaagagatcgagaccatcctggccaacatggtgaacccccgtctctactaaaaatacaaaaattagctgggtgtagtggcatgcgcctgtaatcccagctacttgggaggctgaggcaggagaatcgcttgaacccgggaggcggcggttgcagtgagcccagatcgtgtcactgcactccagcctggtgacagagtgagactctgtctcaacaaataaataaataagtaaataaaaataaagtttacgtccctctaattttgtttctgttactgctacagtatttctttaatgagatgatggtcatactagttgttttttaatgttcctgggggggaaagaaccatgctgccgacactgcccccgctaccacacacacacacacacacacatgcaccctgggaagacttcctggggggaatcccatactctgggcactttgctttgcttcctgacccaggcaggcccatgtgtctctggtccctgtggtcaccaaggcatctcatcccctcagcttggctcacagtaggtgcatacttgttgcacatgtggctgcatggattctttaggcagtggggagacagcactgatggctggcagaggccctggaggctccctgggtttgagggtgcagggtgggagcgggagggatgctgtgtctgcaggatttaggttggggctaggctagtgggtgcagatcccaccctgccccggccaccctggagggacccaggatcgctcctcatcacactcccccgtgataaagcagccgtggtcagctgctcagggctgtggtggggcctaacctgagctggtggctgtaatgcttggtgcccacaaatggggttcttgtgattggcccaggcccagccgaggagtcctgcctgattttaggccagatgccaaatagggcttggcctcggtcctctgcaggggcctgtcctataagagaaagctttcaggtgacagcagtactgggcagtgctggctgggggttcagtgtgatttgctggacccagacatcactgtgagagctgctgcccttggacacattttgctggctttttgcaaagcctcttccctctgcttcccgggcctgcaccttcggcccccgttgtgacctagatcccaagtgcgacagcaggtggggtgggattggggtcacagcaacagcatggggcgtgggggtggggtggttgggccttggagcctggggccacagtggccttggggcactgaggactgtcctgtggtgcccctgggagtgggcattcatgactccatactatgcccagcccccactgctgcctccagtctgcagacatctcccctctgctgtgtgaaggccgcagtgtctggtggctgagcccggattgttacggggagtgagtgggtggctgcagcagccgccacaggactgggttgggggcgggggaaggatttatcactaccagggtctgtggagctcaggccttccgttccctgcaggcctccccatcctcagagcccctggggcatccccgctggctcctgaaatatggtccttgttttgtgggtcaacttcttactctgaatgaagtcccccgaggagcctgcagatcacctgggtagaggcagcgatggcttcgcatttacaccctaagtcattctgtcatctgtgacctgcccactgtgggtgcctgctctcaggagctcccagccttgcacacagcactcatcccaggactgtgggttggggagggcactggagcctgaggggctttccctcaggccccagcagtcagggaagcctcctcagaacctgagccaagttcagagggcaaaggaggcaggtggtagtgtggggagagatgcttggatggcagcgggaacagtgcttgtcagggcccattcagggcctgagtttgaggagatgggcagaggctgggcctgggctgtagcccagggcccttgggtgaggcgggccctgccctgggctcttcagcttccctccccacgtgttgcctgaacctttcttctgtctcctggtctggcctcagccaaggactgtatcttaattgtcctgggttgcgggtgaggggatgagcctggagtctccagaaggagtggcctgggccagattagaatccagccatgcccagggtctggggcagggcttgggcctggagtccacccctgttagggctggggacacaggggccaggtgacacctgtcgctggaagggcaggtggaaaacatcctgtacctgccctgtcccatgcatgcctgcttctccacctgctgcacagcccagggtgacaccaggagggctgacgctgctgggcctggaggggtgacgctgctgggcctggagggctgacgctgctgggcctggaggagtgacgctgctgggcctggaggggtgacgctcctgggcctggagggatgacactgctgggcctggagggctgacgctgctgggcctggagagctggcggctgggaggtctatcagtggatccgctcaccctttttagggcgcccctgtatgcacggccctgtgtggccaggccgttgactgggatggccataggggtccttttgttgcagagctgggtcagagctagggaggggcctcagaggagtggtcctgccagctgtggggacccctggctccaggacagacccccgagtggggagtgggcacggtaacgtgaataatgcctcagtctctgttgtgtggatggagatgggggcagtgtctggcagcgaggggtttccaccaggcctgtggctggagaagctttgttggaaccacagggctggcaggagtgggtgccaggagagcctttgccagcccagcccttttttccaacagctgctgctactttctttggacctttgctcagctcaccatctctctggggctgaggccaagatgcctgagtccagggcaagcaggggcccttctggcacagagaggcctgggtgggaaagaccccttgagggtctttggcctcctatccatttggcccatggcagctccccttttttctctggcctgaagtggtatgagctgtctaattatgtgtcaggggccagatgcaggtgatggggtggatggagctcggagctggaccctgggaccacaggcagatgggcaaagggaggggagacaccgaatgagagaaaggggaagaggaaagttaggacatagggaggaaggaattcatccccttggggctgctcccccgctgtgtggcgctgggcaagtcacttgcctatggcttgttggagggtctgggaggatgtgtgagggaagcacgcagctctgccctccctggtgggtgatgcaaacgctctttcccagggagcatctcatgacagcccacgggcgtcattctggctttcgtgttttgagtttgttgtctgtgcttatgacaggtttcttgaaagtgaacttcagtgagcttccctgccattctctccccaccacctgtagaggctgaaaaagctaaattgggagctgatggtctcaccttcccaggacagaagtcagctctcctttgacttagaccctgatagaatggggaggagagggcgaaagattgcaggtggggccgaggctggagggggccagatgaggggcacagggctgggggtggaggtgagggtctggcatcatttattcattcactcacttgctcactggaggaacctgctatgtagcggaagaccacaggctccaggtgggccaccaagcctcagtgtacccacctggggaccgggaagtgggagactcctctctcagcaaaacaaggtgaactcccgactcctgtaagtgagaatggcagcagctgagttcctgctgggtccggctgggtctggaaggttcaggggggcagagccattgcacctctgttgcattatgtaatttactaagaaccatcacacccgccgctttccatttgtttctctctgtgccctgtgaggtaggtgggaccaaaccatggccccatctggcagatgagaacagaggctggagaaactctgggattcccttcctcttgggcctcagacttggccccaagttggcctttcccaggtgctgccacccccatccctgagtccagggagtgggaaggaggtggtaagaagagcttggaagggactgttaaggtgcagatgtcttcattgtcttcaaatgaaaatcagtgtgggggctgcctttgttggggaacacctggcatatgtttgggggtgggagtggggcccctgggtggctccaggaggctggcacaccaaagggaaggtgaacccacagagccaggcccttcaccttgggatttccatactccgggatccaccagtgaccccgccagggaggcatggtgcaggggacctgggtaccgacaggaatccagggacctaggaggatcagatttgaatgaagctggcctgactgtgctcctgagaagcatacctcccacctcccacaaagaaagagttgcagggatcctgggggatgttagtggcttgggaggggactccaggacgaggaatgagctgactcttgttctaaactgagaaacagaatccacaattaattggatgcatttgctgaacctgggacaggacccaaatcttgttctttttctgaaatataaaccaagccaggagtttatttatttgtgtcccctctccctgcaaggactcagtgaagcagcctgtcctggaaggcagcctggctgagctggaatgtcaccgccttccccgagttgacccgcccaccctgttctcctggtctggtgaaccatgggcctggaggaggccccatggttgagggggtcaacctccccaattgagggggtcctttcctgagggcattcggggcagcaccacccgggggctggtgggcagggtctgttgatcctgggctgttctggcctggggccaacttcagaagcctccctgaggaatgggtgtgggctgcagggctgggcggggggagctgagtcagcactgtgggagccctgatcacagcaaggacagaacctgatgccagcgtccggctttgtgccactgcacttgcgggtcaccctgcctgctgcactgcgagagactagggaggccttccccatagtctgcagtcggctccgcgccactccagtgcttagactgtgtgcctgagccatgcggggagagacagagggaccggagctcccaggttgcactggcctcctggctagcaggcagcgggacccccccaggttcctgctcctgctctccctcctcatctccttttgacttccataaaacgggctaacagcaaaccctgtttgctggtctcaatcctgaagggggaggctagacccatcgtgcctgtgttcctggcttctggcacatagtaggcacacagtgccaagtgaattggcatgtgaggcttcggaggataaaagcctttgtataaggctttgcaaagcaccttacacaatgcagcaaggtggaaagaatatgattttcaagtctcagagccccaggttcaaatcctagctctgctcttcctcagtgctttgaccttggacaagttactccccctccaagtttcagtgtccccttttgtgaggtgggatagtatcctgtgtgggagggttgtcatgaggattaaacgggagaacaggtgtctccatttcacacacgaggaccctgaaggtcggggtgccggctcgtggaccagccctgctccagggcagggagcagggccttaggccagtggggggtgtctagctgcacccatgccctccgtgtgtatcctctagggccgtcctgtctgagtttaggcctggggcccccagcactggaggagtccagggagtccaggcctagctcaggatccagatggtagggcttgaggccttgggaaggaaggaaggggaggggattgtccagagagagcggcaggggcggaaacgtgtggtatcgttctcacccatcataagggccacagctgacaccgctctaacgaaagacaggtttccaagagcaaagcatcacatttctttaatcaatgttttacatgacacgggagccttcaacgatgaagatgcaaggaccagagagaactgtctgttttcagacataagttggtgaggaatggacagccgtgtagacatatgatgggacaacgggtgtgacctaatggtgatagtccgagggggaacccagcaaggcttgtcggctcggcttctttccggcctctctgtgttgtgtggcttcctcccacatacagcgcaggacccctgtggaatgagggtcttcaggggtgaagggagtgggagagagtgaactatctgggtttcatggctggctttggggaaaaggggttttggtctttatgcttcaccttgggaaagaaaaattccagttttgatgactcacctgggcagggaaaaagaggggagagagacagaagggcaggagaaggtcacagagagcttacctctgaggcctttcacatgccctttgttcagagtctgcagtgagccacagcaccacactttggggtgctgtgttctgagccccgacagggccttgtgggggccaggctccaggtgatactgtaagcccccacttccccttccgccctccctccctgacccctctctctgtggacagccctagcgtgggggtggctgggggctgacctggcatctgtgggggggcccccaggctgtgccccactcctttggctccctcctgggatttttttttttttttagagggattggcccctctgtctgtctgctcagccccttactgttgaactgtgctgctcttgatggagagagcccttggggaggaggggacagtgcaggaggagctcctcttcctttcgggcacagggggtgcaggcgtgggctgtggcttctgggacctctgtcctctctccttcatggggtccctgcctccccttcccaagtgcactgcactgtgttggcccttccccgggagctttggaggaggactggatgtgttagtgaaggaacctgggcacactctggggacctttctagatgatgactgggactgcagggtggatcctctggaaggctggtgacttgcccggggctgcgggtcagtgggaggcccttgctgccccctgcagcatgcccctgagctggtggctggcctcagggctgagcctggtggtgctagggactgcgggcaggtgtttggggcctttagtcagcagcactgcctcccacacggggcagccagctgagcagcggtcagcctctgtgggccctgttgctcctgttacctccctctaaggttagtgggacctggattatgcccagggagggatggcacctgctgaagtcacacagcccattagggtggggctgggctatgtccacttctgtcccactgtgtgctgacatccttaatcgggtggggaggggcagtgcatttgtcccccacatccatgtccctctagcccttcacatttatgtcattccactcctccttaccacacagcacaggacgggcagggttagggggaggaagcccggagcccctctgctcccctgaacattcattccacctgccagggcctggggcaggggcagggacagggggtagaggtgggtgtaggggtgtggtggagggtggtatgtggggtaggggccaggcggagagctgggccaagagcctggggaaggggcaaggctaggggcagggccaaaggtaggggccatggggtagggcaggggtagccacgtgactccctccgcatgttcttgtcccctctggctctccgttccattccccccacccaccagcccctattcttttgttgtttttctgagacagggtcttgctctgttacccaggctgagtgtaatggcacaatcatagcttgctgcagcctccaactcctgggctcaagcgattctcctgcttcagcctcccgggtatctgggaccacaggtgtatgccaccacacctggctaattaaaaaaaaaattttttttttgtagaaatggggtctccttacattgcccaggctggtcttgaactcctggcctcaagcaatcctcccaccttggcctcccaaagtgctgggattataggcatgaaccaccacgcccggtcagccaacccttattcttgatctgaatacctgttgatcaaacacctcgtccccttctggttccttcccaactttcctccagccttgatttcctacttctggggccaaatacagtggaatcagccttggactcgaagtaggtccattctcctcttctctgggactcagaacctgccagccttggcttttgtttctgcatcggcaaagatggggagcccctgtggctgagaacagcactcacacttgtgtggaggggcagggcatgctggacaggccagggtgaggcagggaagcccctagaacagcactgggtagaggaaggcctgagaatgccccggggctggggtgagggcagcctcctcagtactgtgctgcgtggggtgcctgttggtgcctcagtgggcacttctgggtgggcgctatctaaagctgactctgggcattcactcctttgaatagcagaaatgacaacaatactgtttgaagtaataccaatgatgtgtttgagataaacacatacctcccgtaggcaccatttactagttccagtgtcatggatatagaaaccgaggactttgattaaggaatgaatagcctggttgcatgtataggttgagcttctcagacaggaacagacgtgtaagaacctgaaggcatccagaagaacaagtcagctcctgtgcctggagtggagtcggggaaggctgcctggaggaggtgatgtgaagggccagcatagcctggcattgctagggaggcaaagtttcctaatgaagactgtgggagtgtgtggcgacccgtggctgttgccttcccacccagctcagaccttcacttggccccaaggcaggtgggtgctggccagaccttccccctcccctgccctggctgctggggagctgccaccgccccccacccacagctgtgccctggctggggctgggctggtgctctgctcctcccagcacaggctgttcccccactgagctcaggaagcaggtgatgagggtgggaggcgggtgggctggagaagcagattccaccgtgtgtttatggccagtgtcctggagctgggctgagaatagcacccgcacttgtgtggagggacagatgggcggagggctggggccaagggtggggtgcgtgcctgtggagacaggctgtcctcagcgagccccacccagcacaactgaagtggtggagggtcgccctgtgtcactgatgccccgcggccatgcccttgctgcctgcctgcgggggtggcactgggatgtggagtagtagcaaggcccatcagggctcctcatgtggccacagcgggttgcaccaggctggccttgctgcgatggccactgtcttcagctgtttggttgatttccatggggcctcttgtcggtttacccttttcccaaaggggcccagcgtaatggggtggcttgcagggtccttgcagagctgcaggcaaggaggctgcagaggggagcttgattggagagaggaaggggggtggttggtatatgctgttccaaggaactggccatgctgcagtggactgtgagccgcaggagcaggtgcactgggcggcaggtgcggggaaggcttatgtgagctgggggttgggggagtagggcgttggggactagggtgggaagactgcaggaactttcagccctgggtggggggagcaggggggaatccagtgctagcggctctgctgggccctcttacctacatgatcatacttcacctttaaacacccttgagggagttcttggctctaagtgatgagacccagcaggtcagggaggtgagcttacttgcccagggctgcacagcctgggcctgctcccagcaccttctgccccagcagtgtctcctaccagaaggggttcctggccagctgcccagactagatgccctgagctggtcatccagagtgggcagtgggagggactgaggggcaggtgggtggggccggggtgtgatagaaacctgacggtggggtgtgtccagtccaccccagggttcctggccattgtgtctgcaccttcctcctggacatctctgggcactgcaaactcactgtgacccccagctgttaccccaacacgtgtccccatctcaggtgatgaccaccccttccctctagtagctcagatcacagagtccccttgcctcccacctgggtcagtgcagtcagcttctgaacaggcaccctgccccactgcgctcctgaagtgtgtacacgcgccagcctgggagctttgcaggctgcaaaatcaagtcttggctcagagctttccagggttccacgttccatgctgggttttaagggccagagtcttccaggggcctctgtggtcctgggggccgaggccgcatgtgcagtggttaaagctcctcaccgatggacccaggcctggggttgggatcctgggcctggctgcgtgaccctggggagttgttaaggcagtgcctcagtttcctcacctgcaaagtgagaatataatagtatttccttcatgaggttatggaggggtccaccatgaggctatggaatcatgcccaagggctcagcatgaagcctggcacctggtgtttcagggcctcctggtcctccctgccccctgccactctcagccacgccggtcttgctgtcctgtggcatccctcccgtccacctcagggcctttgcactcactgagttctctgtccagtgagttctaccttcttcttccttcctggcctggtgtcttgctccttcatcaggtctctgctcagctgtcacttccctgagttccttcctaagagcagccgccctctcccctcacccccagcccttcagtgtctctctttttttttttttttaagagatacggtcttgctctgtcgccctggctggagtgcagtggtgcggtcctggatcactgcattttttgaactcctgaactcaaggcatcctcctgccctagcctccccagtagctaggactataggtgcacaccatcacactcagctaattaaaaactatttttggtaggggtaggatctcactatgttgcccaggctggtctggaactcctgaccttaggtgatttgcccccctcagcctcccaaagtgctgggattacaggtgtgagccaccgcacccgtccccctgctgcatttttgttcggaggctcacagcacctttcaacattgcctccctcctagagtgctggctcctccagggcagagaccttgcttggcttcccatagagcatggccaggcacactgccaccagggcacgttgctgagtcttcaaatgcctgttgtgaggtgatagtgcagaagaggaagccaccttcgtttttgggtgggcgttggcaggggaggctctgattctgtgcctgtcctgctcttggcacccctctcaaggaactgagttatgagaagatccctcctgcgtctggccagctcacccacagtgtgaccaccacagccaccaggccctacagccgagaggccacgtcccagagccggggtggggactcttcacagtggtgggtctggtggaaggttcctttcttccactaagtgctggctgggtggggaagaagctggagggtgaggcctgggcagctggctgggcgcttgatgatggtctgggtgggcgtagcccttctagaaactcctctgtttgctggtggacacctggttctgctgatggctaagaatagactcagcttgggggatggtcccgaggggaggggagccagtcatgatccagggggtcctccagccctcctggttggaaggtggtggggtggctgataaaatccaagggcttggtagcggtgggccgtgtgcggattctagctcattgcttactgacatgggactctcggtttcctcactgtgaaacgcctccctcccctgccaggatttggagcacatgtggtctttggatgagcggttcctgctctgccgtccgtcctgcactgcccttggctggtccagccccgccggccactgtgagagtgctcaccccagccccctcccagcctgactctggcccctgctgcctccactcacgctgtgtgctctgctcggggctccccaggccaccgcagcccaccctggcttcctctggggtccacgtggcaccaccctggctgcaggccataggcttatctacagaaccggctggaatttcaggcaccctgggagggatgagagagaggacggggagggggccttcctggcctggagtcaactggacactcgttctctggggcgggagccttcccttccagctgcagagatgagtgtggaggaggagaccctgcaacttccttcccctcccccttctttctcaggggcggggctgggctgccagctctgatgcagacaggacctccaggggccggccgggctgggagggctctctgtgttttcgtttttgaccatcaaagcattgtggtggggctgacgtagttggtcaagtttttattgtcagttaaggatgtaaaagagaaaacccaacaccactttttgctctcaccagtatttcacaaaggaaagggaaaatcaccaaaaagaggaaggagatcatcattttagagtgacggcctcccaagagaggccaggcagcttcctcagtcagcctttctgagcaggggaccacggaaaagtgtgatgagtctttgtggactggtgtcaggggacggagcatgggggcttgtcaaaaaggtggatcgccatgtgggggtgaggccaggcgcttcctgggggtcatggacttgttaaaaagacggatcactgtctggacgcggtggctcatgcctataatcctagcactttgggaggtcgaggcgggtggatcacgaggtcaggggttcgaaaccagcctggccagcatggtgaaaccccatctctactaaaaattcaaaaattagccaggcgtggtgacgtgcgcctgtagtcccagcgactctggaggctgaggcaggggaattgcttgaaccggggaggcagaggttgcggtgagccgagattgcaccactgcactccagcctgggcaacagagcgagattctgtcttaaaaaaaaaaaaaagaaaaaaagatggattaccatgtgggggcgaggccaggccttcctgggaggaatgtcttcccggttttgtatttcatcgtgaaaatctttgtcagctttgcgttctaatccacaagctgtctatgttggttatgtcacaaaagtgttttctttaccagttcgatctttggatcaaagcaagatggagtgtgaatcttcttcagcaagctccagacacacgcccgctccccccagtgtctgtgtgccccagtttgggagtcaaaagttgagtctgggctttggaactgatcaggtgtggcatcctggctctagagctcattagctgagtgaccgccctgaccctcgatttcttcatctgtaaaataggaccaacggtcatcacctcagggtggcctagggatatgaacccaacgggagggggttcaagggtgatgtgtcccccaaggtgagtccttggaggagagattccctggtggtcatgctttgcactgtgagctttgtggagcttacctagaggggcacatgtgggggcctcaactgggctccatagggaaggaatttgatggggagggagtcccctctgaagtgagagctgagctggcagcatctccctcgagggagggcaggttgacagatgcctgtccctagagccagcccctcctgccaccacctcatatccagcccaggggacatgggggccccaggtatgggggcacagaggagctagggaagggggctgaggcctggctcagctccccctttcggagcagccctgagggtgtgagctgagggggaggaccccattcccccagaggtgctgggcccttcctgctgggggtgcgtctggccaccctgggctcgctcttggtttccccatctctggttttctttcgggctccttcctcattatgggctctccccgggcctccctctgcctcttgcttgtctctgtggcttcttcgtggttcctccactttcctactgtgcccaggagggccatgaacaggtggctctgccagggagggtgtgtgtgagcgtgtgtgggcgtcatctcacactggaggtgcttgctgcatgtacatggccgagcttgtgctgctgtgtggggccctgagggctggggagcgttcttgcctccagatggaatgcacttatctttaaagtcattgtgcctttgagaagttggaaggcatagcctgaagggtggctagccgctaagaagtgtgctgtgtgttctgggcttgcttcctgggactcacttcccggtgcccctgggctctgctctccagcaggaacctgggccacttctcccctttgcagccacagctggggctgctgcaaggggcccagctgcccgtagctttcccaaggagtctgggaccctcattctagcccctctgtccttggctgcaggtctgggtgccctcccctcccaacctgagggtgaagcagcagctctggggtggggcggggcgggggatggagggagaacaaggcctcaatcgtcaccaggagactgctagcttctgggttaagcactgctgctctgaagacgcctctgtacgtgtgacttcactgggttctgaggaggaagagagtttccctgggctggatgagaccaggaagctgccccttgtgcagtcaccagcctggggcaggtgccacagcccacagtcagtgtggcctcctaaggaacactgcaatgggctcagagggcagctgctaggccatgggtctgtctcctttctcacttcttgaagcagacagacctgagtgatgatgcttgttcaccaccaccacaaagccacagaatctgagctcggtcgcttcttcgctgcagagccaaatccttcagtgccgcagcctttcctttcttatctctaaagcaggggtaataatctgcggctctgagcatgagggaacgctgaaatgcctaagagcaatgagcatgcctctccaccgaaggaaatcagggttccttggagaaatggctgatgccagggctggggcagggacagtgcaggctgagcctggagaatctgctagtgccagaaagtaaggaagcgcctggagatgaatgaggacgtgtccgaaacctcccactggtcgcacttgggatgtttgagcatcaaaatgaatcacgaacgcaaaacgaaggactcacgatatcctcaccaccctcctcgcaaaggcaagaccaggggaggctcgtgtttgtggaatgccgggtcacgtggaggagattgggtaacagcgggttccagccaagatgctattgcagtgcttctcagacttcactgcgcatacggtgcgccagggggacttgttaaagggaacactctggttcagcaggtctgcagttttttttctcctccaggctcttggaagactgtcatgcagctgcccacagacctcacactgaatagcaaagaatgatggatagtaaaggcactgtgcaaaaatttcaacaactttttgccttgccacagtgaccgtgattgtcctgcagatgactaagagaaaagtgaccttcctttccaagagatctggcaaacacgactcagacccggcggtcaagcctaacacagctgtggtgcggtgggaaggctcagcctccctctgcaggactcttgccaaagcagcctttaacctgaacttcctcacaaggaaacaatcagatggatccagagtgtggggcattctccaagtgattggtttgcactcttaaaaagataccagtatcacgaaagaaaaaaaatggataacattgataaataggcatacggggaatattctggactaaaggaacaagagacccgacaatcagaagcaatatgtgaaccacagttggatcctagacccagacataaagggcatttggggggcacccaaggatatttgaatgcggaccgtgtggtagatggtattttaaaatacattttggatgtattgggggtgcttatggtatcatgggcattttggagcatgttcttgttcttaggaaatctgttggagtatttaggggtgaagtattgtggagcgaaggtcatcccagtgacccttctgctgcttaccttctgttggctgggcaaacatacaaatgcaggaacggtttatatatagagaaaagtgactgggcacggtggcttgtacctgcaatcccagcaccttgagggtgctgaggtgggaggatcacttgaggctaggagttccagacaaaactgggcaacatagcgaggccctgtctctacaaaaagtaaaaatactagctaggtgcagtggcctgtagtcccagctactcgggacgctgaggtgggcggatcgtttaagctcagaaagtctaggctactgtgagccatgattgcgccatgtactctagcttggacgacatagcaagaaaagagaaaagcaaaaaaaaagaaaaaaaaaaaaagaaaaaagcaaatgagtgtggccaagtggtaacagttgattggtgaatctgggtgaagggtagatgatagtccctgtagtatcctttccactttctttgaggtttatactttgaaaataaggaggtgagagggccacatgaaatgtggaggtgagtggtgggcttagaacctcttttcctccctctgctctctcgtcagggctgctgtggcctcctgcatggcacctagattgttggaggccaccgagactctccacccagaggtggggagcaggcttaggtggctccactgtcggagtggggatggggaggtgtgagcagcagccgggagaggggtcctgtgtgtctggttgcagggacagctcgcatttgagagatgggcttggaggaggggttgtgtgctggggaactaggtgactatgggatctgcgggactgtcctcagactggctccctctgcccctgggggtttaagactcccattgtacccctttcaccactgccaccccagcctgatgtgtcagacagcaggcagcatcttggggcaggagaggggaggcagagggccttgtaccccttcccctgcctgggcgcccaccatggcctgcccacgccaaccctggtctcggtgcagacttgtcctgcgatgtccctggtatccccagctgagtgcctgcaaggcctcagagcttgtgaccacggaggccttcagctggccatcctgccctctgtctcccctgcaggggcccctggagcatgagggcggaaagatccccgaggccagccctgtgtcatcatccacagctccccagcttggctgacccgagctgtgtgtgggagacgacggaggaggaggggcaaggaaagattgacagagggacagcccccgggagtcagtgagcgagcctggacccagaggtggggggcgggggtggggagaaggctcgcctttgtcctgttctaggggccctcctccctttcgcctcttggggtgtctccctcgggactgggcccagagaaagcctggccgggtgtctgacagtggccttccccctgcccgcctgcctgtcctctgtctgtgtctgcctgcctggggagcctcggtgtgagaacgccggggcacgagggtgtgcatcctgcctccgtggcccccgaccgcaggctctgctgggaggaaggggcgagacagggctcacttctcagcccgcccttcctgtgcaggcaggtggggaggagatgatgcggaaggtgagggccttatgcgttttctggggtctcagcagctgggtggtgggtgcctgggagggagatttgctggatgaggtcccccttccatgtgtgtgtgggggtggggtgttgggaactctgctgccactgcagggacgaggggtgccgctggctggtggaggagcccctagctttctgcctggccctggccaggaccagagtgactgggaacgcggccctcacccctccttccttaggcttccctcctgggcccctgggctggtccttctgatggccttgggaagtgcttatccctgccctgggccatgccattcagactgtgggtgtgtgtcccgcaagtgcagcaggcccactggtctctggggccgagggagggatcagagaccccaggaggggctgctggggcccagccgggtgagcccgaagacccggccctcctcactgtggcggctagagctcctggcccctcctgactggacggtgtcaggctgtgtcctgatttgtttgtgctcacctgccatctgtcacataaggacacttcccttctgaggaggcggccctggtgacttgaagtgcgtgcatggtgggtgggtgctgtacgtggtgagctgctcctggctcaaacaagacaggcctgggcacccttcctccttctgggttcggtggccgtgcactgcctgtgccccatgactcacgctgtgggtcagggccttgcctgccatgcgggggctgttggagggtggcaggactccctgtacccacagggagcggctgacgccagggccttctgccctctcactgggccatgacaaaggccttggcggagggctggggaggggcacccacccacgggatgctcccactgagcccctgtggacccgggtgccggaggcatggcgtcaactcagtgaaccacccagcctttctagggaggagccttgggagggtttccttccacagccgaggcccagcgaggctgaaccctgtggatgattgcaggaggaggttctggagctggccacgggttcacactttgtcattcctgccacctgccccccctccctgccctgccctggggtgtcccctccaaggcacttcagctccactcacatctggccttgggttgaggacatggtgagaggaagctctgataggaggtgattgggtgtggcactgataaagctcctgggactgttggctctgtggctgcctctgccgcctgggcctctgtgtgtctcgtccgccgccaagttttcaaaggctcccctttgtttatcacagagtgagtgtgcgtgataagtgtgtgatgagtgtaggtggaactgattgtctaaggggccctcacccagtaaccctggacagagtgcaaatcctggcctgtgccgccagaccctcctcctcacccaactcctgctcatccttcaaaacccagcacaactgtcctgcccagctttccttagtcgctgctgggccagcccctcctggacacctggagtcccctgtgtccctcagtggtctgcctgtgagctcggcacaggggaggccccactaaccaagtgtggaacggatggggtgggagatctgtgtcccagggctcacggccttgtcccagctcctgttctggggcagggggtgcccagattgtttttccctgtggtagccacaccaggagctccttgaggatggggaccccaggccacttgcctgcgttccctcatggatgaaatgggggtaggtgcagtgaggatggcatgtggccaaggccagcctcgcccatgggtcttccctgggcctcggccatgctgtggccttgttattcctcccatttccaaggcgggggcactggagcactgagagcttcagcagcctgaggtctcgcagagtggggagactggctcagcctcaggcttgctgtcacccctcagggctgagggctttctgtacattacccttccattttgtctgggaggagcctgaggctgagaggtgggttgttttgtttagggtcatgtctctgccctcaaagcccacagctcagatgagcagcagccgctgagaatatcttgtgtgtctgtcctgtgcttagccctgtgtgggtgttggggacacagagatgactggaacagtgtccctgacctcaagctgttccttcagggtgagggtgtgaggcacacaggcacatcacatagcagtgaggaaagctctaagtggtacagagtgttttgaggaaaggagagatcagggacagttcacagtgatgtcacctgagtgaggttttgaaggatgcataggagtttgccatgtgcaggtagagtgtgcgcgtctgtgacttctgtctcacatcttgggatgccgtcagcctggacccggtgtgagggctggcggtgtcagtcaggcccatcccccacctgtgtgaaggctgctctgaaggccttttagggatttgccatttcttgaatatcatgggccaggtactgctctgcactttatagacatgatctttgtaatccttgaggagggtgccagtgttcacttcattttgtagattgaggctcagagagtagctgtcccttttcccaagggtcttctcactgctgcgtggagtctcacctgggctggtgtctcgttctcaaggctggaagatctccccagttctccagctgtctgtgcagagcacacagcagtgtttgggaactgggtcgagtgtgtgtctgtctctgtacacctcaggagccctggtggccagtgtgggtggggaagactggggaccttttgctggctgagtgtgtctgtcttcctggggagagggagggcagggcgtggaaggggcatccttcctggtgctcttgccttgggagctgggcagtccctgccctgtttctgagagcttctggctctctctggtggctctggtagacttctgggagttcttttctatgtggtggtctattcctctctttggagggggtggggctgtggggtgggtgcctgagcagaggggctgagtcacctacccaagctctttgcagagccgggtgaggaacctccccagctcagcccactttctggggggtcccttctggatgtggctgccagggaggggcagcagtggggagcctgcaagttgtgcagtgtacattttcttgctcatgtgggggttttgttttggtttttctctcatccctgtgtcagcccttggcatccagctgcagttgcccaaggggctgtgtcccgaccgctgtagcacaacatcatcggtggctgcctcccggtgcccacctgccccctgctgccactctcactttcccactccatcctctgtgacctctagtcaccttgagcaattcaaaactccccagtaagatgctccatctttctggtctccttacctttgttgcaacctctcccctctgtctgagctgccacccactccaggaagtctcactgactgcccaggctagaagagatctctacccccagggtcccacagccttaagtgttcccccatgtcaggacagagacccacatctgattcctctctgctgtaccggccaaggtgcccaaggccaggcacagagcaagtgcttggtgagagatggccaagagcagctggccttgccaaggcttctgggcctggctggggggggaagtgcagcagggcagcacaggacctgcaagggccggcagggtgggaagggtcctggctgtgtcctggtaccaggcatccgttggtccaggaccgtggcctgggccctgggccccaaagctgatgttcctggcagcatgggctggctccgggtcttggaagggagggatgtctgcagacctactggcctcagcagatgctgggctggccctttgctcctggggctccccaccgctcctgggcccacctttttctccctttgctttccactcccatcccctacccccgtttccttctcattcttgtgaggtcttgcccactgcctgggagaggcctctgctgagacatcagtgttggcctttctgccgccctgatggaggtgcctctttggctgcagacgggtgtgtcccgccgccaccctggtcttcccctctgctctcctgcaaacccatctggcactcctcatcccttttctgtgccccagctctttgtctttttcttctcctgctctttcctaccgtgccccaccaccgctccttgcctctgtattttgtctccctgctcccacctctctctccgtcatgtggagctctgggattggaggagcagggcccagagagggaagtctgggagagcgtgatggtcagcatatgttctcagggtcctggccagcgccctcctttcctagagctttcccctctcctggtgtggctcctcttctctgcccttgcccacccatccttcatctccccctgccactcatcgtggggggttgagggggagtccacctctgagactcatggttgggagcagagctgtgagctcatgtgtgtgcccttgtgtgttttgtgtgtgtgtgtgtgtgtgtgggctgtgcagagcagagtgcctggggcaggtcacatctaaaaacccagtcagatcagaagcagactctgcgtggcccccggcagctcctggccaccgctcgctgccctccttgttccgggatggctcctgccggttcagggcctgctctgctgttgcctgtggcattcatgggcctgggcccagggaatagagtcatgcggagaagtgaggctgctcctgcttggcccctcccctgcgtggctcacttttcagcttccagggtgggggcggagcacccaggggtgcagtgtgagatcagctaggagggtgcccgatccttcttgccatctttgaagcctccctcctcctggctgtggtcactacgtcaagcctgtcctaagctccatttttggcctattgtcgagccctgggtagagggtggggaggcctgaaaacctgatggacccagccatgccctgggattgcagccctgggtgggcaccctgggctgggtgatgttggctagagacttcccagcccctggtctgtgctgttggtgactgagcactcttggtttgaccactctcctttccaaggtaacactctccccttctctcttggcttcggcaggttctccagaagctggggaaggcagatgagaccaaggatgagcagtttgagcagtgcgtccagaatttcaacaagcagctggtgagtgtgggtggcccttggccttagggagtttgtgaaaattcggctgccaggtgaaaaatggcacgagctgaatttgtggagtacgagagcttggaggagggtaatcagtgtgggctgacaagatcatgtaagacttcctagaggagggagcactggcaatgcatgctgggaaggaagagggatggggtatgtatgctttaggttcttggtaggagacatagaaacggtagttgggggagggggagggggagggtgggataggagcaggcaatagattgtggccagacttggggaaactttgcatgtcaggggcaagtgggagctatagaagcttcttgccaggagagtggcatctgcagcggttagcatgggggcggagcaggctgggtttgatttgggcatctgctgagcatggtgtgtgcctggctgtgtggcaggctcaaggctgggctgtggggaggcatccgcagccatctccaattggcctgggagcatttgagagagggctgagggcagctgggagggctggggagcagctgggagggcctgggagtagctgggagaggactgggagcagctgcgagggccgggagtagctgggagagggccgggagcatttgggagagggctggggagcagctgggagagctgggagcattctgggacaggaccaggagcaactgggagggctgggagcattctgggagagggcggttgggggcagctgggagggctgggagcattctgggagagggccagggaacaactgggagcattctgggagagggccggggagcattctgggagagggcggtggggggggcagctgggagggccgggagcattctgggagagggtggtggggggcagctgggagggctgggagcattctgggagagggccggggagcattctgggagagggctgggagcagctgggagggctgggagcattctgggagagggctgggagcagaggggagaggccccagggccaagttggccttggcttgccagaggggctcagcctgacaggcttccctggacagggattggggagcccccttagctgattgtcctttaggccagttatgggaggagtttcaaggcccaggtagaccctgtggcagggatatctactgcctctgtggctctgggcaattccttcccagagcttcttgggcctcagtttcctcacctgcagaatagaggcttgaacaagaaacctggtcttaggttctgattccatctctgggaagccccagggcatgtccctactcagctggcttcatcaggctgtgggttgctctgaaggacctttagggagttgctgtggccatgggccagagctgctgtgtttgacagagatctatgcaatccttgagatggggctgatattctcattttgcagatgaggcacttgaggctcagagaagttaagcacatcttccaaggctatgtagctggtgtgggtgttggggattgaaatccaggctctgtggcctttggttcactatcgagtttcctctctggagctgatcccttgtcctgagggcagctggctaggctggggagacaggttaggggtggaggtggtgggggccccttagaacaggctgagctggccgggcactgtagctcacgcctgtaatcccagcactttggggggccaaggcaggcagatcatgaggtcaggagtttgagaccagcctggccaatatggtgaaaccccgcctctactaaaaatacaaaaattagccaggcgtggtggtgtgtgcctgtagtcctagctactcgggaggctggggcagaagaatctcttgaacctgggaggcagaggttgcggtgggccgagatcatgccactggactccagcctgggctacagagcaagactccggtctcaaaacaaacaaacaaacaaaaaacaggctgagctttggcagagtgagggaagcacagttgggagctgagactctgtgtggcctggccccagggctgaaaccacagtgttgctgtctccactgtccctcagagtcatcctctctgggtctctgactctgggcaaacagtcactcactgctccttggacagaggggttgggcagagagtccagggctaaagatagccagtgctgcgggctgccaggtggctgctgggctgtgggtgtggagcagtcctgagctgggcctctgtctgcccccgggctcaggtttggtggggtggctggcttttcaggggccagggctggtagttggggtggtggttttaaggtcttgttcaaggctggggctaaggcagccagttctggatttgattggtgtgtggggatggcagggtgtggggaccaggaaggaatggggtgaaggtcactgttgttgggggagtgaattcaggaggctgcagtgggcttgggggccctgggaaaggagagagagaatggggcgtgggaagcctggaggtggagctttttcttgcctctgattctgtgagccccaagcctagtgggcccagcactacaagggacaaggatggcaggtgatttagtctttaaagaagtgaacctcccaccccttcttatggggtggggggccctaggagagggtgtagatcagcctgctgtcacctgctctccaaggacccaggtgcacagcccctcctgggcccacctggcgctggtcacagtagcatcgctgccttctgcccctgctctgagagcccatgggggcctgcttgcccctcccccagagtactgcacacctggcacaggcccttctggaagccatcctgggtctccagggcatcccagctcttcttcctagggtccgtctgtagctttccaggctgcagggctgtcattgctgtttgtctgtcactgaggtggggcaagtctgattccttcttgtccccatggcccacccaaggttttgctcaaaatgggcatccctgactattgagtgaaggtcgccccccgaattgatggctgaggggtgccagagggggtccacgtaggagggccgtccctgccccctagacccactgggagcacagggacttgggtgctcaggccacctgtggggactgatgtccagggaggtgcagcgagggcttggggatgctggctgagcccagccgcgctggagctgctccaggaccttcctgactcccccaagtcctgtagctgggacacaggctgaggtgggcagtggctcccgaatcttatcttcccccagctgggctctgtgaactctgggacctccagagaattctttctcagatccctgtttaggggctgagggagccacttggaagcaaacacacactgctctgtactggcctggacgctgccctgcggagggtagctggctggggcctccgtcgggggagggctgtgtctaccctggggactgatgaggagcttaggaagccagctgcagtgggcacagggaggcagtgctctggccggccccttgcacatctgcgtgccacgtgccggcgcacagcccagcgttgtttgggaaacacaaggagccctggtacggcctgaagcccgggggagcacaacgacccaccccatggggacccctgctgtgggggggaggtggggacggcgtgagaggtgtggctgggatggtggaggcctggcagggagagaagctggatctggaagattctgtgacatcagaggacacgatagcatcccatcatgaacacactttaatcctcgtctcgaccaacaaagcctttaattgtgaagacttagggtggctgtgtcaggagtgaggtggacccttcctcattccccggccccgcggggtctccatccgaccccctgatggaattccagggaggtctcagtgtccgtggagcagtcttctgtttcttcactcagtctcacatcggtgggccttggacttggatgtttgtaaagatgatgattagccagtgttatacaccctactctatgggggattaaaggaattttagagatttttttttttttcacacatgctctctttaaattatacatcttatgtgctgctctgaagctccccctgtggatgtctctactgtcacacggaagcattcatcataataggcagatctgtgggttctcagggccgcatcactacccattacccacaaaacaccctgcgggctgcgtgcccaggcttggagggtctcatgggctctccgagtctctgtgtgactgggccggtcgctgaccctctgtccgcttctttgctgtcaggtgggacagtggtgttgagaagactgcctggaaggtgctggcccctagggcaccagggcaggaagagcagccccggctaaggacagggagaggcctgtagtggggagacagaagagggtttcagggtgctgggggtgagcctgtggatgtggccgggtccctgctggccttcacctggaggtggacctgaatggatggggcccaccttccggctcttgcgcaagcatgaagctggccagactggagcgctgcaggcatgctgggtctcctgggaccatggccagctgcccctccttcagggcaggaggcgactggaacatgggtgtccctgaggcttgggctggcagcaggcaggggaggccaggagggtgcccttctactacgaaggtcagcctcagccactgccgctctcccgagtcccctctctgccttgtgttcctgtccttagcatgaaggccatctcctgaggcctgccttcaagctccagggcctggcctagctcactggatctgaggagtgccaggcagggattattcgccttccactgaaagacgaggagactgaggttcagagaggctcactagcttacttagggctgtgtggctagtaagggacacagctgggtctgcatggcctcaaagcccgtgtgcagcccactctttgcacgtggcttctggaaacttctgcagctcactgagcatggtctcagacctcagtgctggcctcacctattgttcacccctcctggaacctggagttctccactcagctttcctggctctggttttgatgtcccagagggacttgaggcctggcccatgcttctactgtctctgctggtcctgctgtctcaggaagcccctggaggacactctccctgctcagggagcttcaccacccagcccactgtcccctcagccttttccctctacatcctatgtccctgctgtcagctgggccagtgatcctggccatgaccaccgcattctgcacccctgctgtagtgccgtctcttccgcaggtcttctgtccctatacaggctcgcaccgggccctcttttcctagtacgaggcagtgggagctctctgtccttgggcaccacctgagcttgtggagcagggggcctggtggtcaccacacctgccttgcccatactcctgtgctcattggtcacttgtctgcaggtgtctgagggcaggtctgtgagtgccggggctgctgcacactggtgctgtgctgtttgtgtgtcattcagccgtacctccagcacgtcatctcggaggggggtctttgtcttcctgccttccttcctgggctgagaatggcatctggaagatggcaggtgcccacaagcatgggcaagggtgcctatggacgcagggcttctgaggcaggggtggtgaccgtagctgctgtcctgttgggaggtcagctgatcagtggctgctgtcaggagagcagcctggttcattcacgtgagggtggcaggaaggagagggtcagggactgggtgtgccaccagtccctgacctggtccttgtccttctctttgcagacggagggcacccggctgcagaaggatctccggacctacctggcctccgtcaaaggtaggaggcaggcagagcgcacctggcccgtgtagagctggtgggtgcagagctggggagggtgggacaagcgctatcagtgggaggcccacatacttcctttctgccccacagccatgcacgaggcttccaagaagctgaatgagtgtctgcaggaggtgtatgagcccgattggcccggcagggatgaggcaaacaagatcgcagaggtgagcatgggacaggtgggcctgcccttctcagagggccctctggtctcagctcctgtcccactctgccgtgccctctgggacaagcctctctggttctcgggcattcgcgtgctgtgtgccctggggcaagctgccctccctctctgagggcctttctcctgacacgccctcacaccaaggtgggtcagatggtgggtcgtggtcgtccttatttgtgtgttatggctcacaactcacaaagcctccctggctgaccccagtcctcagcgtatctgatcctcacagtcaccccaatagggcaggaacatttgcccccatcttacagatggggaaactgaggctctgagaagccactgagctgtgaagagatggggctggggctggtccctgcgaggtgagcgctggggcgggtgtggcccagccctcctggtggcactgtcgtgctcttgcctgtctcagaacaacgacctgctgtggatggattaccaccagaagctggtggaccaggcgctgctgaccatggacacgtacctgggccagttccccgacatcaaggtgagagacccacttgcagatctgccctgctctggcctggagggaactggagagaggacagggcctaggacgtgcggctcaggccaggaggaggctgtcctggaggcaggaagcgcctggcccggtgtttcacccctccggggttgctccctctgccaccagcccacggccccccattcctttcctgtccctttgggtctcagggctatgggaggaagcctcacggcacgtgtgtgtgtgtgtgtgtgtgtgtgtgtgtgtgttgctgcggagtggctggctatatgattgtggaaggtgtagaagggtgagtagggcctacacatgtgtgtgcctgcaggtcccctgtgtttacaccatgggtgcttggaagggtatgtgtgcatgtcacctgttgtctgggtctacatgtgtgggtgtgtgcgtgtggttgtgtgcattcgcaaagcctgctgtctctgccaggcctgggttggtgctcggagctggcagtgtctctggtatccaccgaggcgagtggtccccggtaacgtgcacatggaagcctgggttgaccattgggttggacgagatccccttggtgggcaggatgggggtgtcatgctcatgctagcctcaggggtccccagtgcagatgcctcaagctccctgagtctgatgttggtggctgtggagatgagaagccaggggccaggccaaggaaaagacttggctgacacgtcaccagctggtggacacggacacatgggctcatgtgcaaggaagtggtttcacacagtggggctggacggccaggagggggtgagctctctgccacgaggagggttccagcaacaagggctcaagggttcctgtggagctggggtctcctgcccgccctgcgggtccctccaggatccactggacctggagtctcagcaggggtgccaggccccgcttagtgccctcctctgtctgccccagtcacgcattgccaagcgggggcgcaagctggtggactacgacagtgcccggcaccactacgagtcccttcaaactgccaaaaagaaggatgaagccaaaattgccaaggtaagggctggaggcgggtcggggcagcgtctgcagggggctgagagagggcgggtgtctaggaccccgagggtggaggcttcctcctgcctggccccaggtggctgaactgggggtggggacgatacagggcccaggccggtgagtgagaggcccttgtgggtgcctgggtgaggtccaccctaggcccattcctgccccccgtgccaccctggcccctcagccctgatccaggccacctgccagcctgagaatgggcctcctgggtttccctggaacggcgccgccctgcctggcgagccgggtggaattcgtcacgcgatcccaggcgacctgtccctggctggagcgagccagtaggtgcagagctggccccactcatcctttggtgaggggctggggtggccccgtcctccgggcagggccgtgcttgctgggccccctgtgctgctaaccacgctcaccttttgcctctgcagttggagttcaccccctttccttaccccccgggctccccctaattctctcggcctcaagggcccatatctgcttggggtggcccccgcgcgtggggcgtgtggacctgcatttaatctgtgtgtctctgtttctctctccccacctccctggtctctccaccttcctttgccttgacctccccaccccagcctgtctcgctgcttgagaaagccgccccccagtggtgccaaggcaaactgcaggctcatctcgtagctcaaactaacctgctccgaaatcaggtgacactggcttctaaccttgcacgtgctggcgccttccggtctgtcgtcctgtcctctcgccctgcggtggaatgcagggctggcatctgagcccagctggggcagggtttttcaaaggcctctgctgggagagctctgcttcagaggagacctgaagtcaaatgtaggggtcaaagaaccggctgaggggctctgtgtgacctgggtgggggcatagctatgcccgctccgtggctgcatctgtggtcattcctggagactcctctgaaatcctagtggtccaggaatgcctttgagccattgtcctctgtgagggctcctctggggagggaggcgacatcatcaggcccctgtactgccatgcctgtccttcaagccacatgacaactctgagatcatcttgaatttactgagcagagaaagctgcccagagaggcacatcacagcctcctcccagggccccagagccggttaggggcagggttggggctctcctgactgaagcccctgcgtcattttcctcggacttgtggtccccgtggtgactctggaggagttactgggaggaccctccagtctggatgggatgctgagacgtggaggggaagcatgggtccttggcctttggggattcatggagggcaagtgaccagcaccacagtgttcctggggggcttcccggaggaggcttttttacaaaactcctgggccatctcaccatcctggccatagaggctatggtcttctcagccccctgccctccaaatgggttacagtgtggccagggaccactggatgcagtgccctgtgagaggtgggtcatgtggttttctcgccaatgaaactgaggcacatttcaggtcagtgtagtcacagcctggatgtggccctcacacttctccatattcccgagaggctggcgataggggcccggccccggaggttgggtttctctctgggcagctgccccattttttcggagcctcctcttgatttcatcatcttcattgagtgcctgtgacgtggagagctctgggtgggcttggcatggcttgctgtccaatttctttttctattttttttttttttttgaacgggtttctctccgttcccctggctggagtgcagtggtgtgatcatgactcactgcagccttgacttccccaactcaagcaatccttctgcctcagcctcccgagtagctgggaccacaggcacgcattgccgtgcctggctaatctttacgttttttgtagagactgtgcctcattatgttgcccaggctggtcttgaactcctggggctgagcgatccacctgcctcggcctcccaaagtgctgggattacaggcctgagccactgctcctggcctggctgtccagtttctcacctgatctgctgcctgatttattttaggccaaggctgactttggagacactgagtgttgacagcctcatcctgaggtcagggtgcccatggggaaccaggggctgggggtgatgcctagggggacttcagtaggcctgagacttcatctgcctctggaggtagaggaggaaccaggggctggagtgggtatgccctgccagtcagttcagcacttgggctagaagggaatgggactactgacggagggcccgggtttctgaataattttccctgaaacaggtgaaacatttttttgtggatgggagaacctcttaggaggctatggggcctgcccactgcttttgggctcctgggacaggtgtggttgggattatgctgggagggcctgcctccacgcccaccctgggggagcagcgagagggtgaggcaggtgatcacacctttgggtgctgggctgtgggtgtttcacattttggccaaactagctgtcccatttgggtcccatctttatttgagcacatcctccttgtccccagcccactcatacctggctggaggctggagagcctttggagtggcctgtgggcagctggctggctgtgagatggcacagctgggactccggggctgccctgcttgggaacttgactttggggagatagtgcatcctctctaggctgcaccagggggctggccggctccatgcagaccctgggctagttctgagctgctctccacacctgcctcagcgtcctgaatgctgtcctcgggaccccgggcccatgtgactctgctcttccccactgttagcttcagtggagctggggtgggggcactctctcctcatggcagacagccctcaccttactccctgccccttccacatgcttcctaaagagccagaatatgaggaatgtcacccaaagggaatacaagacacgggtcctgacttccaggaactcaagcggaactgtccccgctcttgctctcggcagcgttgctgagcggtgagagcacggctgggtgcagatgttcccacagacaagctgcggtgctgtcttcactgctgtccccaccgttgccatctggggagttgtgggggtggtggctgcatcctcatggagagggggtcctagtgggtacaggagccgggtggtccaggcaggttcttacggaatgtgggactttagacccactgttggcagttgagggcagggggtatgtgtgatggtgctcagctcacaacagtacccctaggactcactcattttatgagttccatagaaccatggttggcagcccccctgccaggtaatgggacacccaggggagtagggcagggatggcccagccatagcctggagacggaggaggggcagtattcccctcctggtgtggggtgcccagggtccctggatccaagagaggtgtgcatgttggaatagacattcttccccaccccccgctccccattctgcctttaaatttttattagattctgaaaagccaggcaaggagcccacgcccactctagcgagtagctggaggtaacctttcagaagccatggtggcccctcctccagtcccaacccaagtcactgggcctaggggctgacctgggctagtcctggtgtctgaggctggatgggacagctggctgggcttggggcaatcgtgtgctttgtggttaagtggccttccggccatctggctgcctttgccagaaggcggcccagcctgggccccagccccggcctgagaacgtgaggctgctggcgggaagtttccctaggcggggcctgacactttcctgggctgtgactcagaccccgaatccctgagtcactctcgccggcagtgtcctcccgcagtgagccagcacagccccttccctgggcgggctgggcaccgggcagggtctgtgactcacctgctgcccgcagtcccttccccagcactctgtggccgtgtgatggggcctgagcaccactgcctggtgggtgtgagtgcctggaggatgcagggcctgccctggggaaggtgtgggctaggagtgggaccaggcacagcccagctgcctggctgcctcctccctggccctgcaccctcctctagggtccccctgacattcctagaggtgcctgagtggctgcctctggtctccctctggtggggacaggtcccaggagagggctttgtgggaaggaccatccctgggaggtgaagtgaaggctggtggctgaggctgccaggagctggccctcagaaatggggagggagcactcaggggcgggggcaattgggggcagcgacagatgctgccctgagagccagaaggcagtggcagggctggcacctagcctgaggaggttcattgtggaagtgggcagggtccccacttggctgggtctggggtctgcctctgtgcatgtcccgtgtccagctcgccaagccccaggcttgcccctcttgttgtgccctactccacgctcactgccctcccggccacgtgggcctctctttggcaacggctgctcagccctccctttcccagatgtcctcagggtcctggagggctgcagggggaggtcgccagcatgggtgtccacatccagttcagcctctgtcttgcccggagccctggtcccagcgcactggccaagaggggtgggcaggaggtgggaggactggccatggggctgggctggctgggacgcccaacagaggggaatgacccgtgctgccccccaggccgaggaggagctcatcaaagcccagaaggtgtttgaggagatgaatgtggatctgcaggaggagctgccgtccctgtggaacaggtgaggcccagcacggtgcccagcctgcgtggggcagtgtccagtctgcgtgctgcggtgcccagtctgcgtgctgtggtgcccagcctgcgtgctgcggtgtccagtctgcgtgctgcggtgcccagcctgtgtgctgcagtgtccagcctgagtgctgcggtgcctgggccctctctggtttgtgcctctgatgagcgtgtgtggtcgctcgtgggtgggtatttctgagttgctgtcctgacctgcctgttcacctggcccccatccttccgcccttctgtagccgcgtaggtttctacgtcaacacgttccagagcatcgcgggcctggaggaaaacttccacaaggagatgagcaaggtaggccatggggacccctctgaggggccacaccccaccctggccgagggtcagagtcagagtcgtgggaggggcagcctgaactcctccttccctgccaggttcagcacacaccggtgaccacagggctccctcccggccctgtggaacagcccccttcaggagtgcctgggcccaggagggcagcagggcatgctggggaggctttgagagtgtcctgggtccttgcctgggtagaccacctgagaatgtagaccaggccctctcaaactgtgaatgtgttctctagcaaccttggcccagggagtgcagtgttagacaatggtggcagtttctcaatttgtaggaaaaaattactagcattttctcaattttaatttttctcccatgcttttgagacatttaaataggcctgtttcgtctgcgtgaatccactgtgcgacagggtctggtctgattagcgtacctttctctcttgtgttattttcattttaacctatctggcaactaaaacgcaaagctgttgaactttgcagttggagagacccagggctggcacccccgcccccagtggtgggtctgactttgtctcttgggcccagatggatgaagtgatgatggtggattccaggcccagggtcggaggaggaaaagcagcttggggcctcccctgactcacacttctaagtacggtttcctgccttttagactttctctttccttcttaacttttcctttttcccttcgaagattggagacaacttacgaaaagtttaaaaaatagagaaaggtgtttcagagaaggaacatttatataaaattagtctgtaaaaatatatgccacagaacatagttgtttataaataggatgaagattcggctctgagctccctagtggccaaatcaaagagaggaatattctcagtaatgagaatcaccgtgtgtgaggaataaacctccgctcgtgcctgtgctttcagtgaaatatctggcagttgtagtgtggtctgaaagcatcttggcaaaatgaccttaacaattaagattaatggtctgccaaaacaagttttaagagaaaaatgtaaaaacagtgcaagctctatgtggcattttaggatatccctataagtaggaggggaaaagatggcttccagagacagcaggcattagtgatatagcccacttgccccgttttgttgcccccttggtttttcggggtttggtgtgctagttccttgctctcacagatggggaaagaggagcttgttcctggcaggggctgggggtggtggggagaagcagaggtgtttggggaaggtggggccgtttggtggccttggaggccccccacctcctcactgtctctcctgcagctcaaccagaacctcaatgatgtgctggtcggcctggagaagcaacacgggagcaacaccttcacggtcaaggcccagcccaggtgcgtgcggggagagccctggcgcccctgactgtgtgcacggcaggggcagggctccttcctgtgaccctgttggtgccctccctggtcccccatgggtttggccttgggggtctagggaccttcctgtcttggcctctctgtgctcagggaggcaggtgagggcaggtctctgtctcgaatgtccctgcccctctggctgtgttcgtcgaggaaggagcactctggggagtccgcgggtccctgagccggctgaccccctcattgtggagcacgagcatccagggttggggtgggcagcctgctcagctttggggactggggggtgtgaacaggactgaaagactccggggtgtgcagtcctctcagagcagggagatagcaccgcccttccctctcctgctcctggaaaagctcatgtccctggatggcagcattctgctcaaccacacgagcatcctcttcctgtcctcagcctcagcccctccgggaatcccagctgcaaggaggcctctgtttcctgaggggaaaccatgagggaggagggaaatgccttgctttcctggctgtggatcagaggaagcagcgagcctgggacttcccctcccttctggccatgtgtgcatgtgtgtgtgtgagggggactgtgtgtgacaggtgtaagtgtgtgcatacccacacacatatcacagcagaacgcagagaacaccgatggactctgtaaaacagggcgactgtctgcttcttggggtattgcctgggatgatgagggtatcgggtggtggtgattgccccctccttccctgaacataaaatagttgtggctgagagaggggccatggtgacctgaggctgggagtggggaggttaggacggtggcgttgtggtggtggttgggggggtgggtagcggggtgggggttgtggaataaaggccaaaaggtgaattcaaggtcgggcagggagggacagctgcctggcctgtaggcacaggtgggaacactgggatggatcagcagggggtaagtggggccgtcctggccagaaccatggctcccctcaggaaggaggtggagggaagagagaggggcagtagaggcccaggagtctcccttccagcagagaggcctcttgtgcactctgtgctcgcctgggggccttttctggcactctgggcacacctggagctcctggggactgggaccacaggcagggtgactctccactgccccgagcctcctgcccctcaccaggccctgttagcatcacctcgggcacctggccacagcaggggccagtcagggcaccccgggatagcacgcccaggccctgtgcaaggcctctggcacttaggagaggcttttgcccctttgtcctctgagcagaagggttggcaaagagggaaggggacaggccagttctgcacctggcctttctccagaatgaaggcctccacctcccgtccgtccccacagaaagaaaagtaaactgttttcgcggctgcgcagaaagaagaacaggtaccggcagtgagtgctgcggaggggcgcagaggcccgcgccctggctggccctgtgcatgcgccttgcgccctgctcccaggtgccactaacccgtaatctggctctgtgtgcagtgctgcccggcagggctgtcgtgtgcgtgttgggtgggaaggcggaggcggcgcggggcgggctggcctctgagcatctggctgcatttagcacgttcctctgggcgccccacacttgtctagccctggtggtgcccgggccaccagcgcacttagcaatggaggacgtggctgggaaggaggcctggggagggccagggaggtgacactgcagcactgtggggttttttgttttttaaacaattctatgtgtataccatatacttatacatatattctttaaggagaatacattcccataaaacacaaattccagaaggaaagatggtgtcagcgacatctcttacgctgttccactgtttgccctcaggtgactcggtcactggttcctgctggatgcttctagatctgcactgtccagcacaggagccagttaccccatggggctattgagcacttgaaactggccagtgtgaccgggcagcggaacttttcatttgaattacacgtaaatttcattgctttgagtttgcattgccgcctgtggctagtggcaaccgtactgggcagcacttttctaggcgtctctgtgcaggttctggtagagaattttctccctgcaccttcgcccctgtgcctggggtgcacagcatcacaccacctccgccttgggttctggcactgaacgccatggctcaggacctgtcccctccatcgccagctgcccactcctctgtgatgaggacgcctctcttagtttgtccaggccctgcttgtggcctccagcagccgagaggacaggagagccaaggtctagagacatgtaccagggtgctgtgatggacaggcagggagggcagcaggctggggagcagaccccagaacagaggggctgctgcgtgtggtgtgggagactcactgtgcctctaggatgtctggctttctcctgctgtggatcttgggctgtcagcatgggccctggtggaccccatggagcctgtggggtggttggtctggtctctgcgacagatggttccaagggacctgcctgcactcctggggaccatagacctccagcctggagtcccaccttgtgctgttcctgtttctgaggcaggcttcccacttccagccccccaagcccaggtcccttggctccccccaccctcctgctctctctcacatacacacacacacacacacacacagtttcacacctccatatgcacacacctcttcacacagacgtcaatacatttgcccctccgtctcctgtgccttggccccccaacactgggctccctttcttgtcctcccccacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcaggtaggagtgatgtcttggtagcaggtcccctgccctccctccttctcctccggctttgctgttgtcctccatcctcccactcctctgtcccctttctggcctgggcagctatggacccgatgctttgcccagtgggggttgggcctggacctgggtctcctttcccccatccagcctggcatgcttccgggaggcatctgtgacttgctcgctcctccccagcccccacccccactgcagcgccctccccttccctctccctggtcttttgtctgcttgactctttctccatcttcttttcctccctagcagaggctctgggccctcagcccacagagcatccagatctccagagtgggctgcctgtccctcttcctggcctctctctcttaaaggggcctgagggaggagcccaagccaggtggccatgcaggacctttaaagggacagagagaggaagggctcagaggagggtgtggggtggctaagggggcaggtcctgggcttctggactgtccttgtctccaccccgcctgcccccagcgggccctccaggtgtctgcagggccctaggtgctggctggccaggtgggggtgttctcatagccggggatcctgcagctccccgttttctgctgccgccctgctctgctgctgactaggatagcagggctaaggacatggtgggagcctgtcccaaacagcacttcccccggcctggacatggtgccagtgccttctgtgtattcgttcactgagtccccacaacacccctgtgaagcaggcgctgtcatcacctgatgcatgaggaagcccagcgtcatgggtgtgtgacctgcctgaggtcccccacctggtgggcaggggtgtggcctctgccccatcctggtgccacgctggcttcctctgggatacactcgtctgagctgggctccctgtgggcagccctgtgccctgggaggtggagagaggggcctgcgggaagggagaggtgggcagggggaggctggggcccggctgtctctcaacgactgtttgcttccccagtcttctcaccaggccagtgggagccagcccctcccacagttggccagtgggcagcctggggcctcttctcttcttcgctctccttcctcctctcccctcacttctctatctcttctctctccacacagcgtttctggaccgcctgcctcagtgtccctctcgggggtggcctggggtcttggtgtctatgttggggggctgggagggcagtgactcttcatttgctgcgtcctgctcagtggcctgggtgggactgtggcctgaggtgtgactaaccgtggctttgtctctgtctgtctcccccaaaccccgtgctctgctgtgccttcccgcgcggcccctcacccgccgccgacccacagctccggaaaggcccaccagtccctccgcctcccaaacacaccccgtccaaggaagtcaagcaggagcagatcctcagcctgtttgaggacacgtttgtccctgagatcagcgtgaccaccccctcccaggtcagccgcggccgccgcggcccagctctcctctcttcctgccctctcagggcgtgcatggccttcatcctctatgcttctgtctcaagagccaggaatctggccagagagagtgtcagtttccctctctcaccctttgttccctccatccatcatcctccatcatcctccatcacccatctctgagcatgtactaaggccagatgcagggccacagaggggaaggtgccgcctctcccggcgcagcagttacatcagcagcgccctcgcgacgcagtgggtgctatggcagaggggatcggggagtgtggaggacgtgtggctgtcagggaaggcttccagggccagggagagttggaaggtcctggaatggctgaagcacctggacttcagctcccacagctgctgtcagcccctcgagggcgggggcagcggccaggctgcagggcagaactgccgtgtgcacactccctaagaggcgtggaatgcccagatacagcagggagccacccaggggggcttgggtctctcccgacgggcccttggctcagcaaggagccacgcagagggtcttgggtctctcccagtgggctcttggctcagccgtggaggtgcctctggggagcctggcccacagccccaggtcttacgtccttcatggtggaggtcgggctggagtacctgtgctggaagcgcatcttgccagtgctggagtgggctgacgtgttgtcagatttgcccagaggtggccggccttccccgcactccccgagagctgactgcctcctcaagtccagccctcaaggcctcagccttcctcctgtgggtaggccaggacccttcccacacagagcctcgcctgtagggaaggctgtccagtccaggctgtggtggcctccagcaaacaccttcacacagctcagacgcctagtggggataggttggagggtgtgagtgtggggagtggccgctgggaactgcgaacagtggtcgctgctaggaagggttggggatggtgggcctcaagcccctatgcaaagactaggactagaactaaggaactgaggctgcaggtgtctgggtgggtgacgccctagttcaggggcctggcaggcgcgggagcccctctctgtgggatagtggcagagggcgatgtaggaagagcagtgtgggggcagggctgaggacctccagggctgcttgctgctggcctccccggctcgagcatgcctccgccctggtgatgcccagtgtgtgtgcaggcgagggagacgggatggcatggacactggcaaatactgagcagagaacggtgccagccacttcctataccccattgtttggttttcaatcaccctctgggaggacatcatgcccccatttaacaggtgaggaaaggaacccagggcctgtgccgcgggcccacgccagagcaaggtgtgccaggccaggaggtggtgcagagaccacccgcacccaggctctgagcgcgcctatccctccataccatacctgcctccctggccaccgcgtgtgccatctccaggcaactggtcttcccggtctggtctggggtcggggagccatgacctttgggtggggcatggggcaggggtgggcttgcctttgtccatgacacgggtgcccacgggcttcccggctgtggggtggtgagtagcctgtgtccctgcatggagggacagtcccgggcctgcatggcgaggtgccacctgccggggcagcacagcgaagggatggtcagctctctggcggatgaccctcccctcagcacatgacggatattgctgcctgggttggctgacttttctgagacaggagggaggggtgttgctggggcagggtgggggccactggggagagatgctggccgcccgctggtgggaggcacctcgaggctgtgcaccggcgtcctcagggctccttcagagacggccggttatggggcagagcagtgacctccctgccctgggttccccagacagggctggacctaaaggaaagtcagctgctgggattggcccagggcagggcttggggcctagggcccctggttctaggaagtgagtccacttggcctgagctgtctgacaccttggcttggccatgtggactgctccacgccttgtcccctgagctgcaggacagctgggtcctcttaggactgaggaccttgggtctctcccaatgggccctcggctcagctatggaggtgcctctggggagcccggcccacagccccaggtctcacatccttcatggtggaggccgggtgggagggcgcccctgtcagtgtccggtgcctgtcaagagtgtgtagagccgggaagccgctggcctgggctgcggggctggagttcttccagcactgcctgagggccccggaggggagcaccccggccacgtccctctccttttaaacctgggcaaagttctctctggcccccaaagggaagccccaggtacaagatggagaccgcagccgagccagtccctgctcctcagaaggcagcttgtgccctgggcatggatgctgccccagggctcaccggagtcattgtctccgcctgtgccgggggctctaaggaagccccttcctcccatgctagtctggcccagcttatggggaggcttgtccctgtgtggccagggccaccgtgtcccatccctggggccatgcctgtcacatgcctattcctgggctcactggaaggagatcttggcgaggggctgctgggaggggtcaggggcctgcagttttaacccaagtgccccgggtggttctgaagcccccgaatgttgaagaccccactttgaagcttggcctgttgggctttgtggctggctccactctttctccgtccctggagctgacggctggtggtgtcgccagagagtgacctccctgtctggggtggaggaaaagccagtgtgaagtctctgcctttggaactttcccagtcgggagcactgagggtggctgtggcatggtgttactctcgccactggggggtagcaagatcagcagaactcttggcgcagggagcggagaggaggttcgggcattggtggggaggggcccaccagtctgtggatggtggcggaagagagctggggcctggtgctggccctgcggggtggcggccacgggcggacctatgactgggagtttgaggcgggcactggggtcgtcctcctggtgtgggcgggagcctgtgccggggcgcgtggctttgggcagtgctcccgtgtgtgaggtggatgagttggtgcctgggctgtgtgccagcgtgtgtgcgtgtatgtgcgcttgctctgcatgcgtggtgtgtgtatgtgtgtgtgtccacgcgtgtgcctgtgcctgcagtgtctgcctggggtgagggctcccagcttaacactaactgcttcctcctctgctgctgctgctgctgccaagtttgaggccccggggcctttctcggagcaggccagtctgctggacctggactttgaccccctcccgcccgtgacgagccctgtgaaggcacccacgccctctggtcaggttggttgtgcccaccactgcccatgggcccaccagcttccaggtgcccaaccctgggctcatgttgcctattggccacgtgaccccagctaggcctgggtcactgcccttcccctggcacctcagccttcagccctcatcacctcctggttgtagggcaggaagcagcccctgatcagctgggagaactctcagtagggggttactgaacacttcctggcaactttgtgctcatcgcttggggcagaagcatcctggcttggggtcttgaagctccctgagaggtgtcgggagctcggccacctgcaaatcttggagtctacctggctccgagccactcctgtgcctgctgggctggatggcctggggcgagcgggggtagggtccctggggactgcttgccgccctgtctctaacctctgtgctaactgtccttctcgccctcactgctgcgctcagtcaattccatgggacctctgggaggtaagctgcacgtctgctctttgtccagcccctgggggagccactcttccgtatgtgtccaggcccacatgctcctagcctgttcacaggtgcatgcaccccacacaccccccacacgcaggacacacaggcacgtgctcacgcacagggagctggtgaagccacccgcctccagccattctgctgcttctccctctggcaggcccttggaaaaggggatcttcggtttagcttgagacaggggtcccctgagatctggtcctgttttcacagcctgtgagtgtttgcctccagacagaagtgggccggtcacccaggatggacgagtgtcctcagggtgtggggcaggagggcctcagggtagaaggttcttgccttctctgagctttttggcagtggggagctgtttgcgaggaaggggagaggggaggaatggatggtttgagagagtcagggaagacagggtgtggctgagtgccttctgagagcagggcctgcaggcaggtgcaaggccatctcacacagcaccatgtcactgtcacctgatagctcaggacacagaggctcagggaaggctcagtacttgcccaagaactggtcatggtagagccagaattccaacagggtctcctgggctctgtccctgagaccccctgatacaggcagagatgctgggaggggcaggcgggtgtgcaggcgcccttggggcatgcgctggcagcccaggctcctgggagctctggaggctccaccgcaggatttccctctggaggaagccagaaagagccagcctggtgcgagctggtagggccattttgacaagtggatttcggtaggtgctgagcttgggcagcacagtcacacctgcctgtccctttgacagtggtaggagagaggatgtgggaggcgggtggctggccgggctccgctggtacccaccctgcccccaccaaccccagccgctggtgacattttctcttgtcttgtgatcctgcccattgcctttccaccccggcctccccgccccctccctgttctctcctcgtggcctgttaccagcccacagagagtccagccggcagcctgccttccggggagcccagcgctgccgagggcacctttgctgtgtcctggcccagccagacggccgagccggggcctgcccaagtaagtgcccacctccagcccctgtctggcttgtccccagtctctaggggtgcagcatggaaggagagccccgaggaggggttgcaggagggaccaggccaccatggatgtgagggtgaggacagggtcctgagctaggctgccccagcacgggcttgtcaccaaggctgccagggatgagtgagcgcagctgggcgcatcagcccctcctgcttgcccaccccagcccagcctcccagcgcaggaggagcatttagagcacctactggtttatgccaggcactttccagaatcttctcatttaatcttcgtcatcacctttacagccagacacttcctccttttacagatgaggagatgggggctaggagggttgagtaacttggttccagcactcagaagtggccaagtctgagtgtcggcccaggtcagcccagctctggggttcctgcagggcctgccgtggtgcccgtgctgcggtgcccgtgctgcggtgcccattctgtgccacacccttcttggatttgggctgcgcacaggctgcaccgcaccacctgcgctgggttgtgctcaggctgggacagatgtgtgttgctgtcccctgccatggactatctataggtgcagcaagatcctgccacctgccgggtcaagcagggtgggcgggtggtggctgtggctgggcgaggtcttggtgccgagagagcagggcctgtgaggcggggttgggggtggcactctggggcttgcactgggcttcttcacagcattgtcactcacatccctgggcctgccagcgcctactcttcagctgcttccccggcccagggcccagcttgtccagcagaggctccctggattcttcgaggcactgggcagctctagaccctgctgccagccaggcgatgcccccggccctgtcgcttgggtgctgccctcctgtggcctgtttcctgtgtcctggctgtgtcctgtcctgtgtctgaccccaagccggcatttatgttgcagccagcagaggcctcggaggtggcgggtgggacccaacctgcggctggagcccaggagccaggggagacggcggcaagtgaagcagcctccgtaagacagcagggacaaagccctgccttttcctccctgccgcccgcctgcctgtccggggctcccctgtggcccctgctggtgctggtccaggcctggctcctgttgaggaagctggaggcgggccggtctggcaccaggcgcagacacctttctcccctccccgcccctcttctcctcggtggccctggctgtccctggaccacctccctgctcagctgacccgtacctctgccaccagagctctcttcctgctgtcgtggtggagaccttcccagcaactgtgaatggcaccgtggagggcggcagtggggccgggcgcttggacctgcccccaggtttcatgttcaaggtgagcccacagcctctgactgctgcagtccctcggtgccctggtgggcagatgagaaccctgagcctcaggagactctgtggtttgcccaaagttgtgcaggcgctactaggtcactcccagccagcaaggtggcatctgagccccatactgtcctgctgcttttgagcactcctggtctccatactgccacctgcacctcccacacgcaaggcccgtgctctgtgcagggctggaggtgggacggaaggtctgacttgcgatccgcatcctctgcaggtacaggcccagcacgactacacggccactgacacagacgagctgcagctcaaggctggtgatgtggtgctggtgatccccttccagaaccctgaagagcaggtgagggctgggtggggccgccagagcgcagggggaccacaggcatcctggctgcggctggcaccgccgtggcggagacaggccagcagggggcagcagaggcccgcgagcaccagggctcccgcgccaactgctcctccccgccctccacgtcgggctttttcctctctccctctcctctcccttcccttggcccctctcctgttaggcctctctctctccctgtccccatacccgcttcttcctgtagcctctgctttcttctccccacgtcccccctttgctcaggcgctctcagctctgcctctgtctctccccttctcctctcctggcagctgtgcctgaggcctgcctccctcctgggacaggatgcttgacccctcctgccccgcccacaaggtgcccaccctgcagccagccggagcactggttgggctcatgaagccccgtgtgccgtccctcgaggcgggccctgccctgtgcacgcagggccatgggcttcccagctgtgtccccggctgaggctcacccacgatgccttccagacccttctcctcctgctgtggcttcatgttaatctcctggaagtgagggctcctgttgagcctgggtgggtgctaagtgtgtccctcctaggtctgggaccctcctggatctgggtcagttgcccctcccagggggccttggactcttggcaggagcctccccgctgtgtagagccagctttgcttgtggggggtcggtggtgccatgtgggcatctggcttcctccacggctcagcccctgagcacctcgggctgtgcacagagggcctggccggcttcttcctgcttccagagaacatgtttagccatcaacgcttctgtgtgaataggttatcagagcggctgagggtgacagtgggtctgcctgggtcttggatgaggccgaccctactgggggtcctgggctgggatgtaggggtaccaggtacttattgaggtccggggcaggaggcctgagtgatgaggaccttgtgggcctggcactgatttggccctttctcctaagcccccaggtcttcatggacctcctagtgggccagccctggctgggtaggatttcaagcagactgctacccagagcccacagtgagaattggcctggggctgctggagggggctcagatagggcatgagtagggtctgtgaccaggctgacaatgacacagagggaaataacaaagacccaggtaggccccaggcacagcccagctgcaggggcagcctcggcccagccactggcaggagtggatggccatacggctccccgtgacccacctggggccaggggcctgtcagcactcccagagaaggccctgcgggtgtcaggattgaagcaaagggcaagtcgaagttggagggactggtgggatggccccaagtccctctagaacttgtaacttgttgtcactcccaaaactttctggggttgtttgagaagcctggaatcctggaagggctgatgtgcacatcatgcatgcagtgggactcatcaaaaccagccacgaatggttagatccacctgcggacgacaggctggctcctgtggtgcctctgggcaggagcctcagccagcagcatcagggagtgctgcctggaggaggtgttctcaaggtgggcttggcaggctgaggcaccaacagcaggaggaggggccgtcttcccagcaggttggagtgggatgcgtgccctgtggggtggagccccttgctcatccctgtgcgacctggtgctctgcccctcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaacgtg

SEQ ID NO: 5 - DNA, 11383 bp, Homo sapiens
gcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcgggtgagactgcccggcctcctggggtcccccacgcccgccttgccctgtccctagcgaggccactgtgactgggcctcgggggtacaagccgccctcccctccccgtcctgtccccagcgaggccactgtggctgggccccttgggtccaggccggcctcccctccctgctttgtccccatcgaggcctttgtggctgggcctcggggttccgggctgccacgtccactcacgagctgtgctgtcccttgcagatggccgaggctggcttcatccactgccccactgagaacgagccagacttggcccagtgtttcttctgcttcaaggagctggaaggctgggagccagatgacgaccccatgtaagtcttctctggccagcctcgatgggctttgttttgaactgagttgtcaaaagatttgagttgcaaagacacttagtatgggagggttgctttccaccctcattgcttcttaaacagctgttgtgaacggatacctctctatatgctggtgccttggtgatgcttacaacctaattaaatctcatttgaccaaaatgccttggggtggacgtaagatgcctgatgcctttcatgttcaacagaatacatcagcagaccctgttgttgtgaactcccaggaacgtccaagtgctttttttgagattttttaaaaaacagtttaattgaaatataacctacacagcacaaaaattaccctttgaaagtgtgcacttcacactttcggaggctgaggcgggcggatcacctgaggtcaggagttcaagacctgcctggccaacttggcgaaaccccgtctctactaaaaatacaaaaattagccgggcatggtagcgcacgcccgtaatcccagctactcgggaggctaaggcaggagaatcgcttgaacctgggaggcggaggttgcagtgagccgagattgtgccaatgcactccagcctcggcgacagagcgagactccgtcataaaaataaaaaattgaaaaaaaaaaaagaaagaaagcatatacttcagtgttgttctggatttttttcttcaagatgcctagttaatgacaatgaaattctgtactcggatggtatctgtctttccacactgtaatgccatattcttttctcacctttttttctgtcggattcagttgcttccacagctttaatttttttcccctggagaatcaccccagttgtttttctttttggccagaagagagtagctgttttttttcttagtatgtttgctatggtggttatactgcatccccgtaatcactgggaaaagatcagtggtattcttcttgaaaatgaataagtgttatgatattttcagattagagttacaactggctgtctttttggactttgtgtggccatgttttcattgtaatgcagttctggtaacggtgatagtcagttatacagggagactcccctagcagaaaatgagagtgtgagctagggggtcccttggggaacccggggcaataatgcccttctctgcccttaatccttacagtgggccgggcacggtggcttacgcctgtaataccagcactttgggaggccgaggcgggcggatcacgaggtcaggagatcgagaccatcttggctaatacggtgaaaccccgtctccactaaaaatacaaaaaattagccgggcgtggtggtgggcgcctgtagtcccagctactcgggaggctgaggcaggagaatggcgtgaacccaggaggcggagcttgcagtgagccgagattgcaccactgcactccagcctgggcgacagaatgagactccgtctcaaaaaaaaaaaaaaaagaaaaaaatctttacagtggattacataacaattccagtgaaatgaaattacttcaaacagttccttgagaatgttggagggatttgacatgtaattcctttggacatataccatgtaacacttttccaactaattgctaaggaagtccagataaaatagatacattagccacacagatgtggggggagatgtccacagggagagagaaggtgctaagaggtgccatatgggaatgtggcttgggcaaagcactgatgccatcaacttcagacttgacgtcttactcctgaggcagagcagggtgtgcctgtggagggcgtggggaggtggcccgtggggagtggactgccgctttaatcccttcagctgcctttccgctgttgttttgatttttctagagaggaacataaaaagcattcgtccggttgcgctttcctttctgtcaagaagcagtttgaagaattaacccttggtgaatttttgaaactggacagagaaagagccaagaacaaaattgtatgtattgggaataagaactgctcaaaccctgttcaatgtctttagcactaaactacctagtccctcaaagggactctgtgttttcctcaggaagcattttttttttttttctgagatagagtttcactcttgttgcccaggctggagtgcaatggtgcaatcttggctcactgcaacctctgcctctcgggttcaagtgattctcctgcctcagcctcccaagtaactgggattacagggaagtgccaccacacccagctaatttttgtatttttagtagagatggggtttcaccacattgcccaggctggtcttgaactcctgacctcgtgattcgcccaccttggcctcccaaagtgctgggattacaggcgtgaaccaccacgcctggcttttttttttttgttctgagacacagtttcactctgttacccaggctggagtggggtggcctgatctcggatcactgcaacctccgcctcctgggctcaagtgatttgcctgcttcagcctcccaagtagccgagattacaggcatgtgccaccacacccaggtaatttttgtatttttggtagagacgaggtttcaccatgttggccaggctggtcttgaactcctgacctcaggtgatccacccgcctcagcctcccaaagtgctgagattataggtgtgagccaccacacctggcctcaggaagtatttttatttttaaatttatttatttatttgagatggagtcttgctctgtcgcccaggctagagtgcagcgacgggatctcggctcactgcaagctccgccccccaggttcaagccattctcctgcctcagcctcccgagtagctgggactacaggcgcccgccaccacacccggctaatttttttgtatttttagtagagacgggttttcaccgtgttagccaggagggtctcgatctcctgacctcgtgatctgcctgcctcggcctcccaaagtgctgggattacaggtgtgagccaccacacccggctatttttatttttttgagacagggactcactctgtcacctgggctgcagtgcagtggtacaccatagctcactgcagcctcgaactcctgagctcaagtgatcctcccacctcatcctcccaagtaattgggactacaggcgcaccccaccatgcccaccttatttatttatttatttatttatttatttattttcatagagatgagggttccctgtgttgtccaggctggtcttgaactcctgagctcaagggatccttttgcctgggcctcccaaagtgctgagattacaggcatgagccaccgtgcccagctaggaatcatttttaaagcccctaggatgtctgtgtgattttaaagctcctggagtgtggccggtataagtatataccggtataagtaaatcccacattttgtgtcagtatttactagaaacttagtcatttatctgaagttgaaatgtaactgggctttatttatttatttatttatttatttatttttaatttttttttttgagacgagtctcactttgtcacccaggctggagtgcagtggcacgatctcggctcactgcaacctctgcctcccggggtcaagcgattctcctgccttagcctcccgagtagctgggactacaggcacgcaccaccatgcctggctaatttttgtatttttagtagacggggtttcaccatgctggccaagctggtctcaaactcctgaccttgtgatctgcccgctttagcctcccagagtgctgggattacaggcatgagccaccatgcgtggtctttttaaaattttttgattttttttttttttgagacagagccttgctctgtcgcccaggctggagtgcagtggcacgatctcagctcactacaagctccgcctcccgggttcacgccattcttctgcctcagcctcctgagtagctgggactacaggtgcccaccaccacgcctggctaattttttttggtatttttattagagacaaggtttcatcatgttggccaggctggtctcaaactcctgacctcaagtgatctgcctgcctcggcctcccaaagcgctgagattacaggtgtgatctactgcaccaggcctgggcgtcatatattcttatttgctaagtctggcagccccacacagaataagtactgggggattccatatccttgtagcaaagccctgggtggagagtcaggagatgttgtagttctgtctctgccacttgcagactttgagtttaagccagtcgtgctcatgctttccttgctaaatagaggttagaccccctatcccatggtttctcaggttgcttttcagcttgaaaattgtattcctttgtagagatcagcgtaaaataattctgtccttatatgtggctttattttaatttgagacagagtgtcactcagtcgcccaggctggagtgtggtggtgcgatcttggctcactgcgacctccacctcccaggttcaagcgattctcgtgcctcaggctcccaagtagctgagattataggtgtgtgccaccaggcccagctaacttttgtatttttagtagagacagggttttgccatgttggctaagctggtctcgaactcctggcctcaagtgatctgcccgccttggcatcccaaagtgctgggattacaggtgtgaaccaccacacctggcctcaatatagtggcttttaagtgctaaggactgagattgtgttttgtcaggaagaggccagttgtgggtgaagcatgctgtgagagagcttgtcacctggttgaggttgtgggagctgcagcgtgggaactggaaagtgggctggggatcatctttttccaggtcaggggtcagccagcttttctgcagcgtgccatagaccatctcttagccctcgtgggtcagagtctctgttgcatattgtcttttgttgtttttcacaaccttttagaaacataaaaagcattcttagcccgtgggctggacaaaaaaaggccatgacgggctgtatggatttggcccagcaggcccttgcttgccaagccctgttttagacaaggagcagcttgtgtgcctggaaccatcatgggcacaggggaggagcagagtggatgtggaggtgtgagctggaaaccaggtcccagagcgctgagaaagacagagggtttttgcccttgcaaatagagcaactgaaatctgacaccatccagttccagaaagccctgaagtgctggtggacgctgcggggtgctccgctctagggttacagggatgaagatgcagtctggtagggggagtccactcacctgttggaagatgtgattaagaaaagtagactttcagggccgggcatggtggctcacgcctgtaatcccagcactttgggaggccgaggcgggtggatcacgaggtcaggagatcgagaccatcctggctaacatggtgaaaccccgtctttactaaaaatacaaaaaattagctgggcgtggtggcgggcgcctgtagtcccagctactcgggaggctgaggcaggagaatggcgtgaacctgggaggtggagcttgcagtgagccgagatcgcgccactgcactccagcctgggcgacagagcgagactccgtctcaaaaaaaaaaaaaaaaagtaggctttcatgatgtgtgagctgaaggcgcagtaggcagaagtagaggcctcagtccctgcaggagacctctcggtctctatctcctgatagtcagacccagccacactggaaagaggggagacattacagcctgcaagaaaagtagggagatttaaaaactgcttggcttttattttgaactgttttttttgtttgtttgttttccccaattcagaatacagaatacttttatggatttgtttttattactttaattttgaaacaatataatcttttttttgttgtttttttgagacggggtcttactctgtcacccaggctgagtgcagtggtgtgatcttggctcacctcagcctcgaccccctgggctcaaatgattctcccacctcagcttcccaagtagctgggaccacaggtgcgtgtgttgcgctatacaaatcctgaagacaaggatgctgttgctggtgatgctggggattcccaagatcccagatttgatggcaggatgcccctgtctgctgccttgccagggtgccaggagggcgctgctgtggaagctgaggcccggccatccagggcgatgcattgggcgctgattcttgttcctgctgctgcctcggtgcttagcttttgaaacaatgaaataaattagaaccagtgtgaaaatcgatcaggaaataaatttaatgtggaaataaactgaacaacttagttcttcataagagtttacttggtaaatacttgtgatgaggacaaaacgaagcactagaaggagaggcgagttgtagacctgggtggcaggagtgttttgtttgttttctttggcagggtcttgctctgttgctcaggctggagtacagtggcgcaatcacagctcactatagcctcgacctcctggactcaagcaatcctcctgcctcagcctcccagtagctgggactacaggcgcatgccaccatgcctggctaattttaaatttttttttttctcttttttgagatggaatctcactctgtcgcccaggctggagtgcagtggcgtgatctcggctgacggcaagctccgcctcccaggttcactccattcgcctgcctcagcctcccaagtagctgggactacaggcgctgggattacaaacccaaacccaaagtgctgggattacaggcgtgagccaccgcacccggcctgttttgtctttcaatagcaagagttgtgtttgcttcgcccctacctttagtggaaaaatgtataaaatggagatattgacctccacattggggtggttaaattatagcatgtatgcaaaggagcttcgctaatttaaggcttttttgaaagagaagaaactgaataatccatgtgtgtatatatattttaaaagccatggtcatctttccatatcagtaaagctgaggctccctgggactgcagagttgtccatcacagtccattataagtgcgctgctgggccaggtgcagtggcttgtgcctgaatcccagcactttgggaggccaaggcaggaggattcattgagcccaggagttttgaggcgagcctgggcaatgtggccagacctcatctcttcaaaaaatacacaaaaaattagccaggcatggtggcacgtgcctgtagtctcagctactcaggaggctgaggtgggaggatcactttgagccttgcaggtcaaagctgcagtaagccatgatcttgccactgcattccagcctggatgacagagcgagaccctgtctctaaaaaaaaaaaaaccaaacggtgcactgttttcttttttcttatcaatttattatttttaaattaaattttcttttaataatttataaattataaatttatattaaaaaatgacaaatttttattacttatacatgaggtaaaacttaggatatataaagtacatattgaaaagtaattttttggctggcacagtggctcacacctgtaatcccagcactttgggaggccgtggcgggcagatcacatgagatcatgagttcgagaccaacctgaccaacatggagagaccccatctctactaaaaatacaaaattagccggggtggtggcgcatgcctgtaatcccagctactcgggaggctgaggcaggagaatctcttgaacccgggaggcagaggttgcggtgagccaagatcgtgcctttgcacaccagccaaggcaacaagagcgaaagtccgtctcaaaaaaaaagtaattttttttaagttaacctctgtcagcaaacaaatttaacccaataaaggtctttgttttttaatgtagtagaggagttagggtttataaaaaatatggtagggaagggggtccctggatttgctaatgtgattgtcatttgccccttaggagagagctctgttagcagaatgaaaaaattggaagccagattcagggagggactggaagcaaaagaatttctgttcgaggaagagcctgatgtttgccagggtctgtttaactggacatgaagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatatgggagcacccagcgcaggatcactgtgaacataaatcagttaatggaggaagcaggtagagtggtgctgggtgcataccaagcactccgtcagtgtttcctgttattcgatgattaggaggcagcttaaactagagggagttgagctgaatcaggatgtttgtcccaggtagctgggaatctgcctagcccagtgcccagtttatttaggtgctctctcagtgttccctgattgttttttcctttgtcatcttatctacaggatgtgactgggaagctctggtttcagtgtcatgtgtctattctttatttccaggcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatcta

SEQ ID NO: 6 - DNA, 20990 bp, Homo sapiens
attttggaaacaataccgcaccgtgcggagtggcctcctcccgccccggcctgtgcccgccgccgccgccgcccctgcctgcgcctcccgcctcctgccgcagcccggtgagcgcccgggtggccgccgggggccgggcggagttggatcgcagctccttggggaagtggggagcggagtcgcgctgcgcacgggggcccgggaagggtttgggctgcggacgtctggggtgaccatgaagaactggggcgctggggtgagggaacggggtgcagaacccacagttgggtgcgctgctccaagagggaacttgggggtagcatttgggactcgaaggagttgggtccaggtaggcaggggaacctggggtgcactgctgagcagacctgggcgcccgagaacggcccagcctctgggtctgactttgggataggacaggagctgtggggcatcctgcctctctgcggagtctgaaggctcctctccttaacagctgggctttttccctccttcccaatcgagtctgggcgtccagcccccgagtgctcgtcacgctggaccctggcgcggagccctggcatcacgactcggaggccgagactctctcctggagtcacccaggtctggggtgtgtgtgtgtgtgtgtgtgtgtgtgtgtgttcctagtcactgtcgaggatctgggtgtctgactactgccttctcctaagaggaggaggagtctaagttcagcatccctcttccagcccttaggggttgggatggctgcagcggggcttgagttcctttgctaggaataaagcattccctggccctgttctcaggaagtgccctcctcctcccaccgctctggacatcacctcttaagctcaggagaaaaatttcaccctctcttagtttacccttgaccttggccagcacccctccagaggcgcccacctacaggcaagccacctacagtttgtggagcgtgagaggggtccctggggcttgcagagccacaccttctggctgcacctcccccactgtccagtccaggcaaaggttgaactttggggctttgctgggagggggaggggaaggtgataggcttcaaaggaaaaaccaagacaatgactcgtgctggtgattggctttgagggccccttcttaggtcaagattgctagcctgagaagaggaggttggagagctggaggggagcccctgccaggtgactggcgggacagcacttggtcctttcatcaggaaattttgtttcctgttgttaataagctggagtgcaccacctcacccccctccccatacacacacacacacacacacacacacacacacacacacacacttgggaaacacggtccaaagaacaccacgtggctgcttgccatcctagcaggcatctcctcattctccagggaagagggcacagacaggaccatagacagctcagggacagggatgggatgggacgaaggcagggcccaagcaagcagctcacagcttgtgtttggcaaaggcagcattctgaattgaactgagattcttttagctacttcaccaatccatagaccatttggcttgttcttcaaaggcaagagactaggggacagaacccccaggaatctctaattgagtctgacaagaatgaaattcatctctttttatccttagctgttcaggtggttgctgcttctggctgctgcaggggccctaagcagttcctggtatgtgtagggagctgggttggaagcttaagatgctgagtagctccaagctcagactttcaagagccatcaggtggagcaagaggaacttctttatcaccaagaaactcatatcaataacttcagcagtataggcagtgagtgaggtcacagggagagggctgaatttcacttccttctgtaagaccagttgtaccagtctcaggttcagagctggcaggagcgggaggctgtggaatcagggatttgaagtcgtggagactagtgaggagacttagttgggagaggctggacctaccctctaggccaaactttggtgggcagacagctcaactctgctcaaagagagccgagacggcagctgcaatgactagcttgggtctttatcccctctcccaggacacattcttaccacactgcagagcctgtttgttgtgttgtgcaagcaaggggtggagattagagtagatgggcagcagggcggggcttagaggtttggagggaacctggctgtcctaggattgctggcttttgtttttgctgctgagcctggagctcagctcagactgagataagaatttccttgggacaatgactctgtatgtgtgtgtgtgtgtgtgtgtgtgtgtgtgtgtgttgtgagcactgtatgtatagccagtcacagcacccttgacagcaacttacagaggctagtcttgtttatattttcccaggtaccctgcatgcatatagctgctgattctactcctgctattgctcacaaccctcagagtcaaactttgtgaccggcctaggtcagaaaacgtgatcaagaaaaagggtggttccaggcgggcccagggaagaggtgtggagagcccctgaacattcaggcagtccacatttggggagtgaatgtcacccttagcagtgctttattaccagggttgtatgtcatcagtatgtggtccggccagctcaaataagaagggggagtatggtaggaagaagggaaggggagtccttccaggtatggccctggtggggcagcagcccagatgcctgcgttgccccctcacaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggtgagtgctctcagcctcaagactcctcccatagagactgggggaaaagaggggactttccctccccaaacctgccctttgctgtttccttcccccaaagtgatcagcggggctgttgattccttgacttccacctgctgcctctcggcttgttattgctcctcacctgtgcctcagaccccccaaagggcaaattgtcccctcctggagggatccttgggtccatggtatctccttttacatcttgtgccccttgagtggcctggcctttagtgtcctagcagtgacttgcctactataaagtggctcctgttgccctggagaagtctgggggatctgtgactggctgttgacaatgaagggaaaaacccagccggttctgggagggagggttcccaaaggcagaaggtggcccccagttgccacatgggactttctgtgtgtgaaaggggaactggagaaagaggttgggcctgcctgggcccaatgccaggagaggggatgcttccaaggctaagacaagaccccttcatttgtgggcttaaatagtttgttttatgagaaatatgccctcctctggcaaaagggcagggttagacagtctgttttcttctattagcactgcagcttatggagggagggtaaaggctaggagcgtggcttactgtgtctgacgagctgattgaggagacactgcagttactcccagagggaactgccccttagggcagttctggcaaagcagttctggcgggagtctgagaagttggataaggcgggcaggcggggaagagggaaaggagcgaggagcccggcggactggcgcccctagcggtggttctaacgcgtgcactgggtaagtgtggagcgctggtctagaggtcttgcctggggctgtctccggagagcaacttggcagctctgtgcgtctcagttttctctccctctttttgtgctgctgcccaggagcttcgggagaccagccttactctactgcactaaaaaagtgaagacactttttgattttttcttgctctgcctcttactttgctcaacccagaaactggagagctacctccagtgcttttccagagaagagcttcaacctgctactacgtgaataaccaactgtggttaagggtagcttgataaataaggacggaaggctggcatgttcgcctgcacacgttaccacctgccctttgtcatggcactgtcagtgaatggagaagcgaagagaaggctggggccattctttctgttctgcaacttttatgcacttgggcagcaggctgtccaagcttggcagagtgctccaatagaggcaggctggctcctatcctttctcatatgaggatttaccctcagcctccaatcttggccaggtcaggcaggcgtagggaggttggagcagttgtggagaatgctgagatgtggatcctctatctttgcaggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaagtaggcacgggggtttaggggaggagggttgagtctgctggggcttgggggccagggcctgcctctctcctcttgtcagcaactctgtctctgccagacctcaaggatattgtcccagagttttggttatggcggttcccatgggcaggaggggcctaactggctaagcatcttgccctcatctctgagctccacattggttaactgcccagtctcaattcatgttccataagagccctctcgggagaggctacagtctgggaataggatggctttctgcagctctgcttgacaacctgtctcttcttatggccgtggctgaggggttgcccctcacggacctaagaggaagattttccgggtgctgcaatgaaactgggcagttggggggtgcctggctaaggtacagtgggaaacgggtaaccaggccaagggatggggcctgagttggggaaagtggtggaaccggttgaaacctgacactttccagctggggaggccgctcctcactgtctctgtctgggaaccagggtctgggactccggagagtgtacctcggagaggctccccagaccggcggccagccgggcgctcagccgggcgcttggccggcagcctggcaccagccccgccagggcggggcatcacgtgtcagccgagcatgtggcagagtccatcaacaaaggcggcggctggcaggctcgtgctggaggagccctctgtgccatggcctggaggctgccttccctgttccagcagccgctgtctgggctgggtccccaggcacttaacccttcctcttcgggctggctttctggatggctgccaaggctgggagaggagcctgaggctgcatccgtgctggtacagccacagctgaagcacaggcatgccacctggaagcgaacacattctgtacttctgggactgtgtccccagcccagctggctctgaatgtgtgtttgtgtgtctgactgcgaggaaatcaagggaataaatagcttgaccatgactgggcagactccgaggttagaagggtagcttcaggtggtcggaggagagctattggtaggttgacttaagggtcaaaccattaccagtgccaggggaagaggaattgaccttggctttcctaagaacaggacattgcgggttacatatggttagtgccctctgccaaggagttctaaggacagtttggggccaggtctgggcctggtaagtcctcccagtcccttagtgatcaggaagggagggtggccctatgcttagataatagatctaagctccagttcttactctctcctttgattatttggtggaaacttggcttcgagtttccccttcagtccatgtgtggactcactctgattcttgttttcagtttcttggcctccttcctgcccattcactccaccgtggttgtacaggcctacggctgagcccagctcacagcttccagtcctggtactggagaggatgggaggacacagtggctgtggctcttttagactcatctagcgggctccgtggaaggcagcttgcttcatttgcaataatctgatctctttcaccagttattccccagaatattcccccatccactggtgagcctctataggcttgggaataggccgggagccctccctggcacaggactaggatacagtcctgggggccctcctaacttggtcctgaacaggaggaggaggaggcccttatcccaaggtctggccctgatttttttttttttttttttttttggctctttcgcccaggctggagtgcagtggcatgatctcggctcactgcaacctctgcctccccagttcaagcgattctcctgcctcagcctcccgagtagctgggattataggcacgcaccaccacacctggctaatttttgtacttttagtggagacggggtttcgccatgtcagccaggctggtctcgaactcctgacctcagatgatccacctgcctcggcctcccaaagtgctgggactacaggcgtgagccactgcgcctgccttgccctgctttttgctggttggcatcacttctcccagttcagagctgcctctttgcatgcacaggttagttttagacaaggtgttgtgcttttagccagagccacccaagctggggagaaggaaagtggaggtgcaaggcatgagagtctcctctgccttgcaccttactccacactggctcccaggtttcctgtacccctaccctcctgccatctacctacttcttacttacaagggtaggaggctgaccagtgagccttttctagctcaaagagctggttttcccaaattttccagtacaaagagccagggttttgtcttctccttaaacagttctccccagagtcttcttgcttttaaccccctcctccccactgaccctacttatagaccttcaccaggaactcatcctgcaggaagggctaaggtgatggcttcaggcaggtggaacactggtactcctggaacgtttcagcagctggttttgagaagtgagtcattttctaagcttgattcttatataaactacagtctaagatttcatatctagaaagtactgttgtcactcctccattcttatcctttatcttctttccctattcccttccctcatttttgcaggcagagaaactgaggcagtgggaaggaggttatttaggatttagtttctaggctttgggttcagagtcagaaagcccaggtttgaataccagctctgccatctactagttttcaggaagtcacttgacttcactgagcctatttcctcttctatgaattagtgctaataccacagaattttactgtgataattaagtgagaaaatacctatgagagtttgggacacacagtagatgttctttaatgcctgtttccttctttctgtttatgatcctgatcacccccgacgtttgttcttgttggttcacaattcatttcccactccacctggcaggggactccctgagcagagctgcctcccctgaacttccctccacctgcctggtccagaggaattagtgtccagactgatcatctgtggaccttggccttatcgatttctcttcagggaatgatagtcattccccatcattgcgggctggatttagagagccaagaaaagcaaccctagaggcagatgggacttgaggaggcctgaccgtcacctttcccctacatctgggatagtgtcctggggctagacagtggccactggtccatagtcctgtggagagtgtgcactccccctttttgtccctggttacagacctgagttactcgtttttttgcaccagaacgaccttctcccttggaggtatggagcagagggagggggcgtgctgatgccatgaaatcccaattgagtgtatcgacctggctccagatgcaacaggttccaagtttccctgggtgtcgttttacgtgggccatctgcactttcagcgcatttcccaagagccttgctaggtggaggactagcctggtcacccgagttaccagttcagggtgactcttccagatccacaggcaaaaaaccggaggcagaagatcagagttagcagggtgctccgcctcagctctttgtgtctccaaagcagcaagagagttggaggcagagtgagtggaggtaaaaacctttcagaacctcaccacacatcccaccttcctttggccggggcaggagtgaaggttcccctgtttgctcctctgtgagctgacaaactgtggcagggacccccgatggtctgctgataatgacttatcttgagggtggtgctgtggtgcttctgtgtccagcttctgcatggaagagcatggtgcagatgtacttcctccctgagcccctgggctgccctggccagaaggtctgagccccagctttcctgtccttgtgccatggcctcattcagcacgagcctaaggaggggcaggaagtggtatcccctccccttgggagagtcttctgtcccagtggcccatcatgacatttgggggtatttctgggcaatgttaagaagccaagaatcctcaaaaacagtagttactgtaaacagtcgagtgagtaaagctacaggagggttggaattcttcatgttggaaatggctttttcacttggaccaggagtggctccattcagaaaagccgggtttggaaatctctgaatagtaattagactttttggcaaatgaaatctgagaaaactttcagccactcagttgaaaccatctttagctgtaatatcacaaaaaggatcctagacttgtaggcagatctgttaaaatcccagctctgccacttataagttatgtgttcgtgggcaaatcatgtaatctctccaagccttttttttttttttttttttttggtgagacagcgtttcgttcttcttgccaagctggagtacagtggtgcgatctcggctcactgcaacctctgcctccgggttcaagtgattgtcctgcctcagcctcctgagtagctggaattacaggcatgcaccaccatgcctggctaatttttgtatttttagtagagacggggtttctccatgtcggtcaggcttgtcttgaactcgcgacctcaggcgatccgcccatctcggcctcccaaagtgctgggattacaggtgtgagccactgcacccggcttagtcttggtttctaatacttaccttgcctagttgatgtgaagggcctttaggagttgtgatacaaataactattaagtcagggacagttgagtacttttagaaatatgttaaaagatgactttaggattttgcttggacctgactttgtaatttggggagctcttttggaagttgtacccgagttggtgtttgcatggtttattaactagcagcttctctgcctagcagactggatcctttgttcagggagcccctgattgcttcctgacactttgggattctctagttattagtgagtggttttctggaacttaagctggctaactaggttgctcagcgtctagatgggacagccccgggcaggggccccagaggtttgctatagagtgagatgggtccctaggaagccagcctctgtcccaggagtgggaggcccacctaggacagtgccaggggaagaatgaggctgggggagggactgcggagagccagagtgcgtgagagccagcgccggggctgggggccctgtgtttgctctgtggctggctctgtttatatcgctcgctatatttagcttctgagtcatcagcgtggcagactagaggctgagttccccacacactctgcacctgactgctctctcttccaggagaagggccttgtagttccggagagttcattccctccccaccaaggcctgccatgggatggaaattggcttttttttttggaaagtgggtgatgggaggaggggactaagggagacacaaagaaagaaggttaaagaaaaatgactggtttgccttttgatccatgtctggcagccaagaggtcatgttccatgaccagagcacacaatcagtccgtgtgtgaaggggagggttccatccttcctccttgcctggtttgccttgacctggtcctggacaggacatgaacagtcagctgaaaagaccccaagtcgagtgtcagaacctggggttattttgcatagcataatacacacaacaggcttgtcccccgaaccccctccctctcccttctttaaccagggcacacaccattgtgcccttctgagctctgaagaagttgcccagtagtttgatggagctgttctcagcttgaaggaaactgagtaagggtctcagtagttcctccctccaggctgtggaggtgcaaaacaagggtctggggacatggatggtgcagcacagctctgtccccgaaccgtacccctcaacccccagtggctggagccagtgtcttccagttgcgttagaggaagccttgccatcttccactgagagctggctggcttcggactgctcttttttccttagagaagcaatgggcgtggccatggtggcttcaatgtcctgttaacactgctggctgggctgaggaagctcttggcaaggagtcttttttttccttttccgttttgccacgttgctcgttcctcgggcctctgggtcagaagcagtctgaggcagtgggcccactgggtccaaggggttgccctctgggtttcagaatccttggcttaccctggcagcctagaatcctgagccccatggcctgtggctgctgtgggcagtctcaaagcagaaagtcagggatctcccagggatttcgtgagtctgccgggaagatggtgctccccaggccggccctgttgcagagcatattgagagacgtgctctgcaaagccagtgagtcccaggttttccttgtgctccccagggaaggaggagcctgctccttgcagcccccaggcccagtgcttcatgtatatttttcttacgtaatcaccacagcaaccttggacttttagactccattgccactgtgttataggaaactgaggctcagagaagtgaggtaacatgtccaagtcacaccgtaatttgctgagctaggcgtcatacagatttgatggattctggaaccatggtccaatcgccccatacctgctgcccagcaatcacattccggaaaacaagggtacaaggaagcacacatttgctgccccaacccgctctgcctcatgtgatactcagctaggtgctcttgctcttctccccattatattgtaaaacaattgagaaccaagtttataatattttaatcatctttgtatccacataactcttagctcagttgggtgcttagtagctcagttgggtgcttggtagctcagttaggtgcttggtagctcagttgggtgcttggtagctcaggtgtttggtagctcagttaggtgcttggtagctcagttgggtgcttggtagctcagttgggtgcttggtagctcagttgggtgcttgatagctcagttgggtgcttcattaaaatgtccttatttcaacagaaaacatcttcctagcttccttcaagcaggaattttcctgctctcaatgttcctgttcttaattgcaaggctctttctttcagccttggcctgagtaggtttagagaatgacagggaaaagggaagagggaggaaaacttcacatcgtggactgtgcaccttcccctagagtatagacaattctgcattttgaagagattgagtgtggtttcagatcacagtctgaagttataatttcagaccagttttagctttatttctgtttgatcttcagttagctctgcctctgaaagggttatttttttctggtccacagcgtccttactaaatagttaatgatctggaaacaatgtctttaagcatactaggggagcagatcagtggtgatttgctttgaaaaaggtaatgctattttcataatgtcaataaacacactgtaaaattttagtgaaggaacatagctttggagtcagaagtcagggcctcaaattacacccctcccaactaacttgggatgacttttctgagccattgtttccgtcgctctaaaatgggttgattaatacctgctcttcctatcgtgaggatcacatgagaagaaaggaaagtgctctgttctgtatctgagatattataagttgctctctgtttggtaaatttgcattttgtgagttaggttcttttagagctgcacacggcttcgctttgcttcttcctctgatactttggggtgaattagctctagctggagcatctggaacactggtgacacacagagcccccagagggtatgaattggatctgaaaaggggagaggcagagggagattcttatccagggagcgtagggaacacgctttgtgcttagggcagaggctgtgtgggatgaaacagagtttgatttatgtaatccaaccttgtcagacaccacagccagctctttagagaaaaaaaaaaaaaaaaaaaaaaaaggaggccttttactagttgggcctctccccaggtgtgaggctgatactatcacataaagtacatctttagacctggccagacatcagttgttcctggcctcagacaagtgggttatctttcagggctgactcctctgtagtcggtccagcatgcccttgttgagtgcctactgtatgccttccatgttccccattacacaggatgagcagctgtgcattcaggcatagggtgttgcacacagtagggattgaaacatttgtcagctgactgccttcatcccctgtccgtggcaagaaaatgaggctgggccaaagaagccgcatggggctctgatgcctgcttgtgctctcttcattgaagagaacaccgtgatctaccatgttagggcaccttccctgggggcattcacctctattcattccctccattccttggccctgccttctaaaccatgtgagtccgagggctctagggtgagcttcccctcctctgtatcccagccccgacccttgggtcaccctgactgtgtattctgggaactcccattctgtgaggggttccctagctgagtctaggagggcaggcctggttctggggatctgcccttgttgatctcagattgtgcgctgggtgctgtgccgggtgcctgagggtcagaggccaagtacactcattcctggttcccctctcttccccttctcctccacaccctcttgtggaagatcccacgttctctggtgttttggtatctttgtgttcttcatcctgttcagtgaaggccaacttccttcctcctcactgtttctcccactggcctcccttcaagtcttttttctttcctttctagtcaggcccttttgttaaacttttaggaaaaattttatttattgttgtattttgtaatcagggcattctttgattatcttggtttcctcatggaaaagggtcttgtgagggctgccctgaggcgggagaaggccaaagggagcctgtgtggtatctgcttgtagccagagagggctcatgggcccatgggtggttcccaggccctacactcagctgacagaattcagttgttggagctctgagttgtaatcctgaaggtagtcgtggatgacaaactccttagggttggagagcacctttgtggtttccaaaaggctgtggcctggctgccacagaaccacctgggcaggattgacctctggcttggccagtggggtaagacattactttggtggaaagagatcgaaagggactgaagaaaacaccaacacgtgaagtgttttctagcctggaggatcatgagtgactttatttcctcctctgtaatgtcttgtattttccaatatttctacaattaacatgtattgcttttatgattaaaatatacaataaatgatttctgatctctaaaatgtcaccaagggagcttgttcagtatacagattcctgggacccttccttgaaattctgacccagtgggtctgggagaggcctggagactctatacttacaagagcacctcagctggcttagtgacacagttgggtttagaaaccattgatctagtacaatacctgcattttccttataagccaagagagaactcatgagcaggttgatgggagatccaacccgaaagccaggtcctctgattcctggtccctggggatccatgcaccatagagccttccttaccaattcatgagccttaaggactgtcacacgcagaggcatggaaactagttccttcccaagggccggcccatgtatcctgcctcctgcacctaggcctgcctgggtcccctgcaagacctcagccttcctgtctgaaagcactctctggcccacagctgcttctgagtcccccaacgctcccagatgatgggagtctgtgcctcatcttcagagatctcaagttgcccagggagtaggtggcctccattagtggaatttgggagaaaactgaggcatacagagatgagaattgcctcagccccaaatcatagaattctcatctgctttccttggccattgagctgttttgagatgatttagtaaaggggaggctagagggtctgctttggtataaagaaaggtagtggcactctgagcacagagataatgggaagggacatagctctagggccagatggtctaggttcagtccagtccctgccacttaaactagctatgtggtcgctaagtaatgggcatgataatgtgcctcaaaatcacctggggaatcttctgatgctgggtctgcatttccaggcagctctctgatgatgctgaggctgctagtccatggaccaccctttgagaagcaaggatgcagaacacacagaacagagcctggcacctccccacccccgactgccaccctaaccccacgttactattatgaggtgatgattgttcttgccaccggtcttctcagacaagcacctcaggagaactggaattccagcagactggcctctccagggatgagtctgctcctggattctcctcttgttcggccacatgacctctgcacctgtctcggtcagcagctggggaggggaggagagggggtctttggcccagctgctgcaggccggaggcttcgggtttgcagctgagtccattttcacgctgttttactctaaccagattttgttaagccgggtgtgtttcctctttttactcatctttgtttacaaaacacgaggaagccatccatctccccaccctctgtctgccaggcctcttctgtggcacgcccgatttcccttcccctccgggcaggagctgcgcctccagcttgccgggttgttttccaggctcttccacgggggaaggaggaatgctgttgccatgatggacgggggcattccgtgttcacctgggttgtcaggccctgaggccagctgcctggatgcctctctttttgtggcctagggcagcgtgaaggggaagccagcaacctgcatggtggccctgggaaaggtcagggaggccagggctggacagaacctggaagctctgggagtccaggcaacctgggccccctttccagctgtgccgctggcttcctctctcctcttcccatctgaccaggagtagttgcctggtgggggctggtgctgtggttaaagacagtttaagagaaggcttggacacctcatgtaaacttgcttgctgacggggccactgaagtaatccaagtccagcccgtgctggctcctttctgcacactaggtttttattcccctgtccagtgagaaccctgtggagaggcccccgcccagtcctcctgccctggcagacaaagagagaacaaagaccgcctcttccagcaccccccagtttccacccccccaggcctctcctgggaaatggtacctgtgtgggcagggcaccagccccaatctggtgagccactgacccctgaactttgcccctagcttcccagcctgacagtaggacctgggataacctccagagcatagtatatattctttgtttttgttttgttttcaagtatgttcttgcttaatgtttaattggctccagtcagtaggagagcgctccaagagggattatttatggcttactgtcaagagcatctataaaaagggcagcaccgagctggagatgctggggagggagagcgggcgggcgcacaagggtgtgtgtgtgtgtgtgtgtgtgagtctgtgtgtgtgcgtgtttgcactggatgaaatcagatttttgctgcctcagcagtgtggtttaaattgaagattaaccctttgaccttcacagtgtcaaatcacttgcagatggaggccccccctttccccttgttctctgtgttactttggagtcgggggagagaggggggcacttcttctctttctgaagccagtttgttgttcatgcagctgaggtttgaggggctcgggagccaatctgattaaaagcagcacttggctaaactctggaaaatcctgcaagcaggggaaaaagcttaatcctcttgtgcatagtgcatatagagcctagtcttttctttttaatgttaaaactgcaattgtttttggagaactcaactctctcctccacatggcagtgtctctttcacctccccctcctccccgctgtgagctgtactgataggattaaagtgccagccgtgagacttggagatctgaacttttactggaaatgagagggagtcgtctaagattgcgtttgggagttatgttggtcttttttttttttctcccttcagcaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagctcctgccacctccagcagacctcagggagggttgagtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctcttgctcaatccgaggtggaaaaagatcacctcccagtgacctccctcagcccccaggggagtaggtctgtgtccaaagctatgtggcaggcttgtttgaaggacccagaggggcccagctgacctgtctcactgctcctggcagcccagccccatcggcaggtggcccctgcctgggggttattcgggatggttcagccagggcctcccaggaagagtgctgtggagccacggtgactgtcctggacagcaaggagcatgctaccccagtgagcacttctttttgagggacttgatggggaggtggggtaggcagaagggacgtggcagaagcgggaagactttggtcaccatggctctgcaggccttctgcaaatcagtgctggcctgggctggaaacagctctgtgtgtgaaggtgaggactcttggaagcaggccatcctggccagacaccctagcaggaaggggctcacctgtcacccttaggcagcctgagggctggtggggacttttgagtcttgaggggatagcggaaaaagctgagctcataggtgcccagccagcctcccagctaaaggtgctcagagccccactgccccctctctctgtgcaggtggccagtgcccctccctgctctgggagcattgctagccttctaccccatccctggatccacaggggctatcgaggagacccagtgagaatgtagcattttgttcatccccagggtagctgccctggggtctgggcactctgcctctgggagagaggaagaagaaaggggccccattttttaaaaaactgtacagagcctttggctttatgtgtttatgttcttcacatgcatatgtgtgtatgtgtgtatatctttccccccatcaattggtacaatttttaataaaatcatttaaagcaaa

SEQ ID NO: 7 - DNA, 46522 bp, Homo sapiens
tttttgacttaccaaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggtatgtaattaacaacccttcttactccagagtctcatgcttgaatcttttcctttgcttcatggcttcgtgttgtagaaacttgcaaaaacttgtcagcaatggcactattttttcttagatttctttgtcatgcctgggaaaacaaaagttaaaaaatccggaagcctccaacatagccttttaccggggcagaaatatgttagctcacagagacaaagtttggtagactcactaaaactagagatcagaattgtcaagaaaccacaaggcaaatgctagatgcggtagaatagaaaggtgtctccaataaaccactcatttgacctcagggctagtagcagggaagatcccctggattatcacattaaaaatgacatttttttgtttcttttaacaccaaaagtaatgtgtatgctcacatatgcataaaatttgagaaattcaattggaagcccagaaggaaatttgtattatctatagttatgtcacctcgatataaccactgtttgttatggaggttttgatttttgctgtgtcttccttcctttatttatttatttatttatttatttatttatctatttatttatttgagacggagtctccctctttcaccctccagcactcaagctggagtgcagtggcacaatcttggcttactgcaacttccgcctcccaggttcaagcaatcctcccatctcagcttcctatgaagctgggaccacaggcatacaccaccaagcccagctaatttttgtattttttgtagagacggggtttcaccgtgttgcccaggcttgtcccgaattcctggcctcacagtgatccacctgcctcagtctcctgaagtgcttctctgattataatgaaatttagtatgtagaataccatagtttatagactagtcagatggaaacattgactcatgtaatttttatcttccttcgctgatttgagcaactcttgtctaaaatcaccctttccttctgaggtctaggaggtttttttgttgttgttttgttttgtttttgaggcagggtcttgctctgtcacccagggtggagtgcagtggcacaatcatggctcactggaacctccatccccggggctcaaatgatccttctgcttcagccctctgagtagttgggaccacaggcgtgcaccaccatgcctggctaatttttgtattttttgtagagatggggttttaccacgttgcccagtctggtcttgaactcctggcctcaagtgatccacccgccttggcctcccaaagtgctgggattataggcgtaagccatgacaccccacctgttccttcctttataaagtattttcttgtttctaaaaatagccaagttctgcatattgactacatacctcaagtgcttatagaataaatagtattacaatgaaaattttatcactgcattgctcctctgattatgatgaaatttagtatagagaatagcatagtttataaactgatcagatggaaacattgactcatgtaatttgtttttttttagtgaaaacaagtttattagagaagtaaagaaacaaaagaatggctactccatagacagagcagccgactcatgtaatttttaacttcctacactgatttgagcaactcttgtctaaaaccaccctttcctcctgaggtctaggatattttatttatttatttttctttttgaaacagggtctcactctgtcacccagggtgaagtgcagtggcatgatcatggctcactgcaacctgtgctccccaggctcaaatgatccttccatcctcggcctcctgagtagttgggaccacaggcatgtgccaccatgccctgataattttttgtatttttagtagagaccaggtctcgccatgttgctcaggcttgaggtctaggattatgccttccctttctgtaagataaaggcctgccctcttacaggtagcagtctgaagttaagatgtaacacacatacctcacggtaccttgctgtctttgggttgatagatcataaggataaccctgcctcccccagattgctttgtgtctaaaacttaaagcatagagccaagtgctatttctgccacgtgctggaaatgaatgtaagggctccaatcaggctaccaggcttgagaaaaattgtgctgtgtccctccatcttaactttctctctctgggaacattttgatttgggagaaatcaaggtgaattgaattccaatataagcaccctccaagtttcctaaaaagtaacttgcaagtgttggggaaaagttttctgggctgttgctttttgaagtagcctcgccgtaatttttatttttcagcacttctaggaaagtctaatgcccagaacggagaaggttgtggtgaggggagggcctgggaagtcagggggccatatgtcctcactctctaactccctgccccacctctctgtccctttcaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttaggtgaggacgggtctgtggtggagatgggaggatctcccatctagtgttcattctggccattgggctttgaaaggaagctgcagttaagatcttttggttatctacctccttggatgataaaccaggagattctaaacctccttctcagcctctgatgctaatgagataagagttgggaggtcagcaaagcttcaagaccaagccctgggcccagaggtggcttccctttgttttgcttctcactagcagtgaagcccacctcagtgtggcagagcccgtgttttccctgcttaccagcggctacacgtgcagatcttctccctcctgggatccactagtctgtctacctgtttcccggggtcttgagaagagagtaatgcatacttggagtgaaataagcaagatgaaaaaagagatgtgtttctggggtagggagggatgtcatttatgccatgtctagttatagaaatttctatatttttgggtgggaatccagaaaggtaaaaacaggcattttgcccaaagaggtaaaatttaggcattggtcttatcatggatgacagcgttttatttttattttgagacagagtctcgctctgtcactcaggctggagtgaagtggcaccatctcagctcactgcaacctccgcttcctgggttcgagcgattctcctgcctcagcctcctgagtagctgggactacaggcacccaccaccacacctggctaatttttgtatttttagtagagacagggtttccaacatgttggccaggctggtctggaactcctagcctcaagtgatccacgcacctcggcctcccaaagtgctgggattataggtgtgagccactgtgccaggctgatgacagtgtttaaaattgttcactgacatagtgtccacatcagagaacctcacgaagaggagcctttggagggtgttttatggtctctgcgattagaacacattaagccttagcggtggaactggcttccagaacctgagttgcccttgagtcagtggaaggaatgatgaattccagaaatccatatttccattctgctggctaaacatctgagggacagtctctgacacataggggtgttagtatgtggatgaaatcctcactgtttctggttgtggattatatctcgaagctggggtagttttcttcccttttcaatatacaaccgactgtaccttggctggcctggggtcctatctaccaagggcctgtaaagtaagcctgaatttcttgatggaatcaggagatgggaaggcatgtcagaattgtgttttatgcctttttttttttaaatatgccttcttagtgtggtgaaaaacagcattagacttggagtcagaaggcctgcttctaccacttactgtgttatctttatttaaacaagtcacttagaaactgaaagttttcattttttgaacctataaatgggattaataattgtctacacatagagttgatcattcaaatgacagaaaacatttatgaaagcacttgattgattatggtgtcctccacaagtgtaaggctttatttgtcattttgggtgtgtgtcttagaaacctgctctacgaactgtcagaaggcattgactcagagaacttaaaggacatgatcttccttctgaaagactcgcttcccaaaactgaaatggtgagtgggtcatacagaatgggtctgtgtgagcactgtcttaatcaatgattagaaagatgctggaaagggtttttagggagatttattttttatgggagacagtatcatacaatggttacgaacattggctttggtgctggatgagcctagattctggtcctgattctaattctaaacccatgctgtgaggccaatgattgaacttttctgagtctctattttcttagacgtaaaattgtgggcaatcgtatgacttccttctaggattgttgggagaattagctggaataatgttcatgaagcattagcatgaggccaatatttggtatagcattcagtaaatgctcacttctgttggaatctgttgtgttttgtttttgtttttgtttttttttgagacgaagtcttgccttgttgcccaggctggagtgcagtggcatgatctcagctcactgcaacctccacctcctgggttcaagccattctcctacctcagcctccctagtagctgggattacaggcatgcaccaccatgcccagctaatttttgtatttttagtacagacagggtttcaccctgttgggcaggctggtctagaactcctgacttcaagtgatctgcctgccttggcctcccaaagtgttgggattacaggtgtgagtcaccgcacctggccttgtccagttttttctttcaagtgccttttaatctgtaggttagatttcctccctgcccccaaatctctttctttttcttaaaatgtatctgttgaagaatctctgggcggttggcctgtggagtttctcacaggctgagttttgctgattgcacactcgtggtgcagtttggcatgttcctctgtcctctgcatttcctgcagactggcagctgaatccagaggcttcatcagactcaggtcagatccgtttggcaagactataggtagtcttgttttttcatcaggaggtacctgattttctctctctttttctttgatattagcaactgttgatgttcaaccattttatatattgaattttgaggggttgcaaaaatggagatattagaatttttttttttttttgagatggagtctcactcttgtcacccaggctgaagtgcaatggcacaatttcagctcactacaacctctgcctcctgggttcaagcgattctcctgcctcagcctcctgagtagctgggattacagcagcctgccactacgcctggctaactttttgtatttttagtagagatagggtttcaccatattggctaggctggtctggaactcctgactttaggtgatccacccgtctcggcctcccaaagtgctgagattacaagtgtgagccaccatacccggccacatattagaattgtatcatttcgttttcccttcatccattatttggttacccagtgatacagcttatatgtgaatccttgattcttttctttcagttattttttttttttttttgagacggtgtctcacttggtcatccaggctggagttcagtggtgtgatcttggctcactgcaacctctgcctcccaggttcaggtgattctcctgcctcagcctcctgaatatctgggattacaagcaggcaccaccatgcctgtctaatttttgtatttttagtagagacagggtttcatttggccaggttggtctcaaattcttgacctcaagtgatctacctgcctcagcctcccaaagttctggggattacaggcatgaaccactgtgctttgcctagttatccagtttttaagttaattggtatcttatcattctctgaaggtgacccattacaaaatatatataaatttaaactcatggatttaaacatatgtgaggtatttcaatctactgcaattattatccttactgaagttcaaactgaggctgggcatggtggctcatgcctgtaatcccagcactttgggagtctgaggtggacaggtcacttgagcctcaggagtttgagactagactgggcaacatgacaaaacccggtctctacaaaaaatacaaaaattagctgggtgtggtggcgtgcacctgtagtcccagctcctcaggaggctgacatgggaggatcgctcgagcccagagaagtcaaggctgcagtgagcaatggctgtgccattgcactccagcctgggtaacagagtgagaccctgtctcaaaaaaatagttcaattgtcccattttttcccaggggatacatcttcagtttggttcctaagtcattttgacatgaccttagtagtctttgatggcttctttactatctggcaaaaatatcccaggttcatcttgtatattttctacccagtcctggaatctctcatttctcccaaaaatcctgacttcttttaatgagagatgtcatttcaagaccacaaactcgatgctggcatgctcattgcttttgagtaaatatatatgcacacactacgtatatacacatatgtatacacacacacacacacatgcacacacacacatgacctaaaggttcagtaattcttggagaattttaaaaatcaggcgattttgttttagggaattcttttttataaaacattgtaaggatcttctgcttttgccgtaaaatttcagtgcccacatttgcagtggtacaaagcaattacctgctcaaatggtagcattataccttaaatacagaatttctcaaagtcagaggagattcctgtagtttgacaagcgctccaggtggttttcataacattctctcccaagttggggcatccgctcacaaattttccagtgtctaggtttatacataaaatgagaccactttttattgttataccccgtcctatgttagggactctctgaacaatatgaggtggcgggtgagggacgagagaaaggtcatttgttaaagcaatctctgatattcgaaacactgagtgttagttttcaaacaagaaaagctggaaaatgtttttttttctcttttgcttgcacaggttctagaactctacttgaaggcatctgtggctacagaattattattattattattattattatttttagacagagtttcactcttgttgcccagtctggagtgcaatggtgccatctcggctcactgcaacctctgcctcctgggttcaagtgatcctcctgcctcagcctcctgagtagctgggattacaggcgcccaccaccacacccagctaatttttgtatttttagtagaggtggggtttcaccatgttggccaggctggtcttgaactcctgacctcaggtgatccacctgcctcagcctcccaaagtgttgggattacaggtatgagccactgtgcctgcccagaattatttttatggtcagaagcattccaaacatttcccccctactaaaatagcttttaaatgatcaaatgcacatgttcatgtggccaaatgatcttgtttttctcagtataacagtaaaaggaaacgtaactgtgcttagctgtggcatggaattgtgatattaccaggtcaaattcaggaaaaccatatttcctctttggattccaaatgatctcagcttttttttgttgggggcggggtggggagatctcattttttgtgtcagaattgtggctgagttacacacctcagataatccaggttgatctgtattggattttgcaatcagaccagcctttggaagtgtgtaaaggacagtctctaagcaacacagatgtttccacaccagggctcagtgaggctgcattatctgcaactgcaattgcaaaagaccttatcacagaaataaattacttacccaccattggaaaagggcctgaacacccctcagccaaaacggaaaggttctaaattcttacagtctctctggggaaacacaaataaccttgcctttgaggggcattctgggctttgtctttgatagctttcatagaaatgtaagcagtatagctggcctacacatatcctgagagatctcacaactgtcaggaaatccgttctcagcacagcaatcagcatacaacattgagtctaaaggaaaccacacctgaacttactctttaacaaaaaagcaaaaaaagaactttcagatgtttgctgctagtatttgccagagtggtgttaaactaatgtccaggtcccatttaagtatgtgcgtgtgtatgtgtgtgatgtactaaacatctaataaacttttagaaagtataatgaatttccgtaattgcttctggaatcacatcttagccctttattcctcctggtaggatgctgtcaagacatgagtttctggcctggcagggtggctcatgcctgtaatcccagcactttgggaggccaaggcaagcagatcacctgaggtcaggagtttgagaccagcctggccaacatggtgaaacccatctctgttaaaaatacaaaaattagctggatgtggtggcatgagcctgtaatcccagctactcaggaggctgaggcaggagaatggcttgaatggaggtggaggttgctttgagctgagattgcactactgcactctagcctgggagacagagtgagagactccatctcaaaataataataataataataataataataatagctgaattgtgattttttgtttcagaaaattctttttcttttaaaatatcaaatataaaattctttcgaaacattttcccctcatttctttggtgtccctcttttgctggcttcctaagcagtatcatttaaagctgtgacttagagttcagtggttaataacatagactttggcatcagattgtaccagctctgccattaattagctttgtgaccttcggcaagttactggaatttctttgtgcctcaattatttcatctttaaaatgtggattataataatatctacttattcagttgttgtgctgttaatatacagcaagcactgtccctgttgcatagagttatatatatatttggtatctggtattaatatagattgtatacagatttgcttggtaatgcctcttcccctacattcctgagcaacttgagggcagatgctgttatatcttatttatcagtgcaaaacctagtgcctactggccatgcagataacatttgagtgagtggataatcaataggcaagtaaatgtaactctattgattctcttgtagacctccctaagtttcctggcatttctagagaaacaaggtaaaatagatgaagataatctgacatgcctggaggacctctgcaaaacagttgtacctaaacttttgagaaacatagagaaatacaaaagagagaaaggtaagtagcttgtgattgctaacttggaccagaccatggaaattcttaaaccaattggccatgcatgatgttttgattatttgttttgttttgttttgttttgaggcagagtctcactcactctgtcacccaggctggagtgcagtggtgtgatcttggctcactgaaacctccgcctcccgggttcaagtgattcttctgcctcaacctcccgagtagctgggattacaggagcctgccaccacgcctggctaatttttgtatttttagtagcgacagggtttcactatgttggccaggctggtctcgaactcctgacctcaagtgatccacccacctcggcctttcaaaatgctgggattataggtgtaagccaccatgcctggcccgtgcatgatgtttactcatcattctgataatattctgctaggaaagccagaaatcttccccttcgttcattcaacacatattggttgagttcatattttgtaccaggcactgttttagaagttgaggatatagcaaagtacagagcaaagctcctgccctcttgcaacttatattccagtgcagggaagtagttttagacaaacgtctttttctgattctaatatgggagtgagagtatagggaattattttaaatgaaataacatgaaaaagaaggcaggatagcatggggtaagagtggactctatagagtcggattgccaggactccacttactagtggtgcagtggtacttttttggcttttctatgtgtcactttccctatctgtaaagtgggcataataattgtacctacctcctaggtttttgtgaggattgaatgagataatttctgtaaaatgcatgtctggcatggagtaagccttctatacatgtggctattatggctctctcagagagaaaagtcataaagacttcacattctcagaaactactatcaaaaaagaactttattttcttgtgtgtgtgtgtgtgtgtgtgtgtgtgtgtgtgttttaagtctgtctgataaaggtagttctgctgtgatattttatacagatagaagcacagggcaaaagtcaaacctggctgccttaccacgtgtcagtacgctaaatatctgtgtttttctgagttcatttctccactgttaagcaagcgctatacataaaaactcatgagtgtattcatgaaacttttatgccacacccttaatttagttcagtgagtgactctagtgtgcaaatttcttggttgaaaatgaaactagctaagaggaaatgtctgtctaagaatttggttaacacagaatgagttgaggagcaaaatatactgttgtcaaactgataaaatctcaaacaataaaatgatgaataaatgcataatttaagttatgaagaataaaaacagttctttctatcatcaaattatcaaatgagaaataaaaagcagaaggttgatatggaaagaatatttgaaatcctcacatgagctctgagtttttttctaaacacattgtcatttttctgtaatgccatatcccatataaagtaaacatagggcaagtggtcatattattctggatatttaaattctaaagaagacacactagtttctatgtagttgattacatttgcctcagtgagtcttgaagactgagctttgttttttttatttttattttttgagatggagtctcgctctgttgcccaggctgcagtgcagtagtgtgatcttggctcactgcaagatctgcctcccaggttcacaccattcttccgcctcagcctcccaagtagctgggactacaagcgcctgccaccacgctcagctaatttttgtatttttagtagagatgggatttcaccatgttagccaggatggtctcgatcacctgacctcatgatcagcctgcctcggcctcccaaagtgctgggattacaggtgtgagccaccgcgcccggcttgagctttgttatttttatttttatttttatttgagctggagtcttgctctgtcgcccaggctggagtgcagtggcatgatcttggctcactgaaacctccacctcccaagttcaagcgattcttctgcctcagcctcctgagtagctgggattacagatgcccgccaccatgcccagctaatttttgtatttttagtagagatggggtttcaccactttggccaggctggtctcaaactcttgacctcaagtgatctgtgtggggattacaggcgtgagccactgcgcctggtccaggactgagctttatatcagcagagttctagttttgatttttcttttctacaacctacctgtgtgtgatctcttttgggtgtcaatcattattgatattttaatattgactttctttagttctaagagtttgagcctaattctgctgttaagatgaaagactaaaggactaaagagtaggtgtgcagactttagacttttctgtaagtgtgtgtgatccaaagtccaagctaggatactggctttatttaaggaccacctggctaactttctaagttgtcttgagccttggtgtttgcttcagtattttttttttcttttttttgagacggactcctactctgtccccaggctgcagtgcagtggggcaatcttggctcactgcaacctccgcctcctgggttcaagcaattctcctgctgctagtcagaaggtgatttttatttttctgtctgtgattttattttcagctatccagatagtgacacctcctgtagacaaggaagccgagtcgtatcaaggagaggaagaactagtttcccaaacagatgttaagacattcttggaagccttaccggtaggttcagtggtgtgctggtcaatgcttaacaaccggctccaccctccaacctcccctccctgccaccccaaaaaagaaaaagagagagaggccccggtttgtaccatttattgtaaatggtctcaccatggtgattgcaagtaaacaacatgatatcaaccagagtgcacattttctgaaaatttaacagttggctgacactagctgactagtgagagctagttagtttgagttctcgctagttagtttgagctgactccccacacccctgagttgctctgaaatggttcctctgttcttatctgtgggatgcaattagagccagctttagggacatataatctatggagcacagggcgtctgatagtaattccacagttcaagtacagagcttttgtttaatgctctgctgttactgctttgaaattcttaatgtattgaacaagaggtttgccaagcatgtagctggccaacccagagggcaagggtttctggtttctgtggtgctcagctctgaaaggatgggtggaaggggaaacgttgggagaatttgcagtctgttcctcaccatgtgatcatgatccttgggagatatgtgacagtcttccctgggatttgtggttcttccagcagacttgggtaatttctttgccaacatctgtcagcatcaatgaagttagcttggtctgggaaatgttttgtttttgttttcaactgtgataaaatacacataacaaaatttaccatcttaatcaattttaagtatacagttcagtaatgttaaataccttcacattgttgtgcagacattaccaccatccatctccagaactttttcatcttcttttagtaaaactttgtacccattaaacaataacttctcattttctccttccctccaacccctggaaaccaccattctactttctctctctataaatttgacttttcagggtacctcatataagtagaaccatacaatatttgttcgtttgtgactagcttatttcacttagtgtaaagtcttcagggttcatccaagttgtagcatatctcagaatttccttcctttttaaaggctgaataatattccactgtgtgtatatacagtaagtcctcacttaaaaggttgatagatttttggaaactgaatttaagtgacagcatactgtataatgtatttatttttatttaaaatttttttttatagagataaggttttgctatgttgcccaggctggtctcaaattcttgggctcaagcaatcctcccgccttatcctcccaaagtgctgagattacagccatgtaccaccacgcccagccacataccatataatgaaaccaattttaccataggctcattgatataaacaagagttggccaggcatggtggcccacacctccaatcccagcactttgagaggccaaggcaggcggcttacttgaggccaggagttcgagaccagcctggccaacatagcgaaaccccatctctactaaaaataccaaaattagctgggcgtggtggtgcatgcctataatcccagctactcgggaggctgaggcacaagaatagcttgaacctgggaggtggaggttgcagtgagctgagattgcatcactgcactccagcttgggcaacagagtgagaccctgtctcaaaaaacgataacaaaaagccctaagagttaagtttctatagcatacagttcgttgtttcacttaaaggcggagttaccaagaacctactgatgactctgagtgaggactcactgtattacattttgttgtccactcatccattgatggactcttgggctgctgccaccttttgactatttttaataacgctgctgtgaatgttggtgtaaaaatatctctttgaaatgctgctttcaattcttttgggtttgtatccataagtggaaatggtggattatatagtcattctattttcaattttttgaggaaccttcattctattttccacagtgactataccattttacatttccaccagctgtgcacacatcctcagcaacacttcctcaccaagacgtattattctctttcatttttgatagtaggcatcctaatggaagtgaggtcctatttccctgtggttttgatttgctttccttaatgactagggctgtcgagcatcttctcatgtgcttttggcgatttgtatatcttctttagagaaatgtctgtccaagtcctttgttcattttctaattcggttgtttgtagaagttttatttttaattcttttttttttttttttgagacggagtctcactctgtcgcccaggctggagtgcagtggcagggtcatggctcactgcaacctctaactcccaggttcaagcgattctcctgcctcagcctcccaagtagctgggattacaggcgcgcatcaacacacctggctaatttttgtattttttaatagagacagggtttcactatgttggccaggctgatctcgaactcctgacctcaagtgatctgcctaccttggcctcccaaagtgctgggattataggtgtgagccaccgtacccggcctttattttttaattctttttttttttttttttttgagactgagtcttgctctgtctcccaggctggagtgcagtggctcaatctcagctcactgcaagctccgcctcccgtgttcacaccattctcctgcctcatccttccaagtagctgggaccacaggcgcccgccaccacgcctggctaattttttgtatttttagtagagacggggtttcaccgtgttagccaggatggtctcaatctcctgacctcgtgatccacccgcctcagcctcccaaagtgctgggattacaggcgtgagccaccgcgcccggcctatattttattcttaaaaattcttttatggcttctttactattgtcatggtctgatatttttacagttacaatttttagatttaaaaataatttcaattttatagaaaagttgcaagaatgtgaataatataaagaatacctatgtactgttttcctagatttacctacctgttgttgatgttttaccccatttgctttattatttttgtgcatttactcacacttgctctctttctccctttctctccacacacacataatttttttctgaactttttgagagtaagttgcatacatcatggccttttactcctaaatattttcgtgtgtatttcctaataataaggatattcttttacagaactataacacaattatcaatgccagtaaagttatgttaatataatacttttatcaaatcaatggtccatattccaattttgtctgttgaacccaataatgtccttgacagtttttaaaccatctagtacaaaattccacataggatcctatataaatgcaacacaaggctgggtatgttggctcacacctgtaatcccagcactttgggaggccgaggtgggaggaccacttgaggccaggagttcaaggtgagcctgggcaacatagtgagaccctctctaaaagaaaataataaaaattaaaaatacaatataatacaatacaatattgtatttagttgtcatgatcctttagtctcctttaatctttttttttttttttttttttttgaaactgagtctcaccctgtcacccaggctgaagtacagtggcatgatctcggctcactataacctccacctcccaggttaaagcaattcttgtgcctcagcctcccaagtatctgagattacaggcatgcaccaccacattcggctaatttttgtatttttagtagagatggcatttcaccatgttggccaggctggtctcgtactcctgacctaagttatctgcctgccccagcctcccaaagtgctgggattacaggcgtgagccaccatgcttggcatagtctcctttaatcttgaacatttccacaacttttatgacatttaatttcctcttttatgccattgagacttttgaagaatgcagtcactcctcccacctttcattaaatagaattttccttatctttggtacatgtggtatttcctcataattagattcaagctgtacgttctggccagaatatcacagaagtgatgtgtctttctcagggcatcccatctggaaatacgtcatgtccatctgcccccctattcgtgatgctaattttgattatttggtcaagatattttctgatattatcactctgcagttaattttatatagttactattttttccccacgcaattaataagcaagtgctggagagacattttaagattctgtaaatatcctgctgcacatgaaaagtttccccctagattgagcgtctgctgatgattcttgtgtgatccagcatttactatgttggttgtaaaacaatgcttttctgactccagtattctctccacattcgtaagttggctctcagcattctactgtaaagaaggaccctcctttctccccaggaaggtgtttttgtttttttaaatgaaggagaccgtggaaactcgccagatgacctgtagctcctggagcttggcaaaggctgggcaaacgcccacctgaagactatgcaggcaatcaggacatgacacagagccgggagaggcctgctcttcggctctgccctgaacctcattcggcaggtggaggtatttaggcatttgagggaatctcagctttgggaggccactttgtaagtgatcttaagagattaagtacatccttaattaaaagaaatggtaacacctccgcctgcttgctgtgagtttattcatttgaattccccatctcccccaatgggaaataacacagaattgcaattatttataaaatcttaaattggcttcttttctctaggaaaatagcccttgattcaattaattccaatcctagaaaagcgcctagatatctgattgaggtattgagggagagaggctgctccccttgattcttttactataatccaattaaagcaacatttatgggccaactccctggccatgggcacagctttgtttagagagttgcaaatccattcccacctccccgctcccccagaagctctttattattttattttatttatttatttttttgagatggagtctcgctctgtcacccaggctggagtgcaatctcagctcaatgcaacctcagcctcccgggttcaaatgattctcatgcctcagcttccctagtagctgggattacaggcacccgccaccatgcctggctaattttttttgtatttttagtagatacaggatttcaccatgttgacttaaggtgatccaccctcctgagtctcccaaagtgctgggattacaggcatgagctattgtgcatggccatcccagaagctctttaaaatgtggttttccagcactgacattttaggattccctaattctaagttaaattgtctgctaaatgtaactcttcccacccactttttcaacttgttttgtgctcagatactgacatgcatgtagaaacacacacacacacacacacacgattctgctcgttgtctttgagaaattcagtggtttctaaaggggcatggctcagctgtggcctctgaagcgctgtggttccgctgacgtgggatgataacttggccacggcacatgcagtagggggatagtcgtggcagtactagaagtgcaaaggggactggggcacagcatctcacgtgttttcacagacttttaaggttggaaggtgtcttaaaagttatctgggcagccctttccctctccatcaaatgatgaataaaataaaacttggtgaaacatctcatgtttcttaagcacctgaggattttttttttaaatttaaaagaacactgccaataattgggctcaatgagaaggaactctcatcgaattttaagcaacatctcctaatatgtttaaaaattaaatttatttttttctcagccccctgcaacttcagcctcccaggttcaagtgattttcctgcctcagcctcctgagtagctgggattacaggcacgtgccaccgcacccagcaaattttttgtatttttagtagagatggggtttcgccatgttggccaggctggtctcgaactcctgacctcaggtgatccacctgcttcagctcccaaagtgctgggattacaggcgtgagccaccgtacccggccaaatcgatttttttgagtgtggcataaggttttcttaaggagaggcatgtctctctatggaggagacctaacacctgcttctttataaggccttattggacccctcttgaaaactatcaaaagaagttgaaagatgattcagtgtggccaggctgtgggacattcactcattcattcattcattcctctctgacatagagacttgagaggtgtcaacagaggatgcaacattctcgggagaagaaaggcagattagaccttaaagcttttttctagtccctgttctggctgactttatcagccaagggaagaacaaatcaaggaaagccagggcctggaggggctgggcagagcctgctgctgtgtctgcattgcccctaatcccagaagactcactcaactgctggacaaaaccagaaggcagtctggccaggcccttgtctgcctcttagaagaaatctaggattctacaggaagggaacagtggcttatgaaaagaaaggcaggaagccttttggaaagtgaagctaagcctcctttgcatttgttcctgcagagctgggggaacagctcttccccaacaccttggtcaggtccccttgggggctttctgctgaaggctgacggctgagagtcatagggggaagggggtgatggtgaatggggaggagggtacagaaaagacagggtcttagactttgttttaattttgtatttaattatataaaacattaatgtatgcccaaggtagtgcatccttgcctctcctccccacctcgattgccatttttatttgttttttgatttatcttattacttttgaaaaaaatccaacgtatatcttccctttattacaaaagaggtagtgcactcaaataccatttcattttgctttctccatatgacagcatcccctggagaagggtatagaggctgtccttggcatcttactccactatgtggacataccacagctttttcaatcacttcctattggtggacattaggctatttccagtccttagtgtaaataatgctgcaatgagtaagtacccttgagcatatgtcacactgtatttttgccagtgcgtctttgtgaaccttctcctttggatggagagagttggttctcttcccatttcctgccaatgaactttcttttttttttttttttgagacagagtcttgctctgtcacccaggctggagtgcagttgcgcaatctcggcccactgcaacctctgcctcccaggttcaagtgattctcctgcctcagcctcctgagtagctgggattactggcatgcgctaccacacccggctaatttttttatttttagtagaggtggggtttcaccatgttagtcaggctggtctcgaactcctgacctcaggtgatccacctgccttggcctcccaaagtgctgggattacaggcatgagccaccgcaaccggcccaatgaccttttctgtggctgtggattagatatctgtccttccctgcatcaagtctagtttttgttcctcatcctaactgtgtgaaattcctatgtttcatgccctcctttcttttttctcagcaggagtcctggcaaaataagcatgcaggtagtaatggtaggtatttctaatgtactttttacaacttagatcggtatggtagggatagacatatttgatatataccaaggaattcaaggtgacttggaagagaagctttataaataatgaataattcattttttattccaattcaaggcaagacattgaatgcatggattgtactaggcttttctatggcagtatggagagggctgggtggtttctgctctgaatgcctagtatagcagattctagggactgcaggcggctgttcttcctccacccttcagaattaggccaccctctgtgcagcagaaacagcccccgcagggctgaagccttcaggccagtagtgacagcagaatgtgcagtctgggtgcgtgtcctctatggagtggttccagatgttgcttcagagggagagaagaagcaagaggagggacttgaggatggtgtgtttagttccctgaatccctgcccagaaaccataaccttaggaaaatattccagaatctgccatcaggttaaactgcttatgaacaaacaggctttggcgaagtctttctgtggtatgtaaagtttgtcacagaccattcctcatttttttttctggaaaattatccttcagagtccaagacacacagctttgctagcaatttgtctttttgcctaacacggaggttgtgtgctatgatgttggtgacattgaccaggtcaccattattaagcacttgtcacatactaggcactgttcagagagatttcagggattatatcatttattcctccattcactggaggtaggtaatactgttattctcactaatgatgaggaaactgagacccatgaaatctagtgctttgcactgcagctaaaaggcaccgcagctaaaaagaagtgaagctgggatttgaacccagctgtctgattccagagcttactctcctaaggccaggctatcccagtgtctatttatgtgagctcaggtgactgcttcacccctctgaagaataaagcagtttctttcagctttacaattctgcggttccaacatttagacgtgacttcccgtggagcattaccttctctcatggtgaggaggaatttataggtgctctgagccactgaagcgtggatcccttttgctgtattttctggtctggggaatatggacttgctcagcctgaggactgacccttagcagtagttaataactaactcatgccccagagacaaggacagagtttggtgggttctactacaaacttcctgtgagtggaaaaagaaaactgtttgatgttacattttcctgttagtgccatgtgacaaataatgcattgctgactttctctctgtgatagagtcttttccagaggaatcagggagttggcaggaacacttcaaagcagtgtgatcctcagtcgatgcccaactggaactttctttttcccctcttttttcttttcttttcttttcttttttttttttttgagacagggcctcactctgttgcctaggctggagtgcagtggtgtaatcacagctcactgcagccttgacccctcggactcaggtgatcctcccacctcaacgtcccaggaagctgggactacaggcaatgtgtcaccatgcccagctaattttttgtattttttttttctagagatggggtctcactaagttgtccaggctggtcttgaactcctgggctcaagcgatcagcccgtcttggcctcccaaagtgctgggattacaggcatgagccaccacgcccagcctccctctttttccttctctagggaagaggtccacctagcctctttatatccagtgacataaatgctgactcaatccaaccatacttgagctggaagccttgagctgatccatgggatcttaattaattccccacccaatccctgccagcagcatagtttccaacccagacaaagcaaaaaagaatgcgaagacacatcagtctctcccatcaggaagggcatggtggctgaatttgtctcaggagggccttgagagaagcataattctccagaattagatgcgaaaattatcagtgaagaaatctaagtgcttggggaagatatttggagtctgagtacctctctttctaggtaacagagccacaaatggtgcaccaagcctggtctccagggggatgcaaggagcatctgctaacactctaaactctgaaaccagcacaaaggtctggatggtttcttttattccttttttaataaaaaaattttttttccaaatttaatcaaaaggacggtttctttaggggctctctccctagggtccagccttcgatgattttaagggctccgagctgtttgtttcagacttgtttctccctctctctgtaattatctctgttcttcccacctttttctgtatcaatcagaagtgactgatccctttgactgtggaggaaatgctgttacactttgagtcatgcataccctttgggttatttctggagaggggtagtttcttttcttatccattgaagccacttgttttctgcttggataaagatgtaccacgatttcaaggatgattttagctgcccagaggctctgctaaagccagctcagctaatttgcaatcacatgctgtttacaatagccttaaaaaataattgcacatgtttttaaattcctactgtgaatatatatatatattgaattttaaaaattgaatatacagccatctttatatacatatgaatatatatcagccatctttatatatatatgaatatatatgtgtatatatatactttatttataagtatactttatatatatatacttatatattaagtgtatatatatatatacacacactcatatatatattcacatatatataaagatggcggtctcactgtgttgcccaggcttgtcctgaactctcaggctcaaggaattctcctgcctcagccacccaagtaccaccatgccagcttgtatattatttttatattcagaaataaaattacaaaagatttcccttttttgaaggcattagatcactccagaaatgaaccatctgaaaaaaatctttgatatttatgttgtctcatgaaatccttgtgtatgctttcttcattcatgttgctaatatgaaagtgaagatgcttttgcataaaccctgggtttgacaatattaaaatatatattccattttcttaactgtcatgattgagcttctccagccaaaccaggtgaagtctgaattttaatcaggatctggcatttcaccttggaattaattagctaattccacactagggccaggatcttgagaactctctgcctctgatactgggagtggcatcctgaaagaaaggaactgtctaatctttagtgcaaatgagatttatcctttgtcctgggctctaggacttaaaaaagaatctttgaaattttattcagatcacaattgtgcagtaaaagtgagttgcagagtagtcagaatccccagtttttcaatatgtgacttcagaaataatgtggcataaataccccaaggggtttagactagagtataaaaacatggttttggacaggcatggtggctcatgcctgtaatcctagcactttgggaggctgaggtgggcgaatcacttgaggtcaggagttcaagaccagcctggccaacatggtgaaactctacctcaaccaaaaatacaaaaattatcggctgggcgcggtggctcatgcctgtaatcccagcactttgggaggacgaggtgggcggatcacaaggtcaagagatcaagaccatcctggccaacatagtgaaaccccgtctctactaaaaatacaaaaattacctgggcatggtggcgggcgcctgtagtcccagctactcgggaggctgaggcagaagactcgcttgaacccaggaggtggaggttgcagtgagctgagatcacgccattgcactccagcctgggtgacagagcgagatgctgtctcaaaaaaaaaaaaaaattatctgggggtgttggtgggcacctgaggcaggtggatcccttgaatccgggaggcagaggttgcagtgagccgagatcgcgtcactcactccagcctgggcaacaagagtgagactccatctcaaaacaacaacaacagcaacaacaaaataacaacaacaacaaaaacatggtttaaacaactggcatggggagatacatcctgctcttcctcacagtggatccattggagtggttggttagaaacatttaaggccctaagataaggattcctactaagtggctctatctattcttcaagagggcagctgtgtacaggatgaatcggaaccacagaggcctctgtgtcattgtcaacaaccacagctttacctccctgaaggacagacaaggaacccataaagatgctggtaagaaagtctggaacagtttatcaaatgcaaattggggatcttaaaattattttttattttcacattttctttctgtgacttttatcttccatatacgtgtaaggatgatatcatgtttctgagcctcttatatatccctggggagtcatcagtctgctaaagagtggcaagaatctttgactattcacaattctgaatagaggagagcatgtactgggggagagcctgctggattggcacgagacaacttgggcgtgagctccagctccaccactaactaggtgtgtgatcatgggagagtcaagagaccttggcttcttcaactgtgaaacaggatgaaacactggccactgccgattctcaggactgttgtgacaacactgggtattacgtgataggagattcattgtaagattttatggttatgaaaataaaaataatccaaagctttaggctatttgctgtgcaaattttgtaactattagcattgtttcagttttttttttctttgagacagagtcttgctctgttgcccaggctggagtgcagtggtgcagtcccagctcactgcaacctctgcctcccaggctcaagccattctcgtgcctcagcctcccgagtagcagggattacaggcgtgagccaccacacctggctattttttgtattttcagtagagatggggttttgccatctggccagactgttctcaaactcctgacctcaagtgatccgcctgcttcggccttccaaagtgctgagattataggtgtgagccactgtgcccggccttgtttcagttcttcattttgttttgcatcattttattatttcccctttctctctctctctctcttttttttttttttttgtttttaaacagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggtgagagctcttttttttcttccatttgtaattaattagttttatttattttttattttactctcattcaacacctttggtaagggtgagagttctacgttgttctatccatgtacctgttcaaccatctgcctaccctcctgtttatctatttatccatctatccacccattcatctatccatccatctatccacccattcatctatccatccatccatctgtccatccatccatccatccagcaaccttgtattgagtaccagcctggacctggaaaggaagatacagagttaaaaaaagacagagtccttgccctcaggttgcttacaagctagagggatagacaaacaaatagacggggaagggcatccccagctggtaagtgcacattgtgaagtataggtgttatgggaacatgcagaatgagtaccttgcccagatttgaaggatcagaggaggcttctagaaatgacaaatagatgttaggtaaagaatcaggtgaaagatgtgctgggcagagggaatagcatgaacaaaagcatgggggccttttatttgttcgtttatttatcactcactcttacgtcctgagcacctatgtgctatctttggacttctatttgccactgctctgacagcttcccttctgtctctgccacatgctgtcctcttggcacctttagccatacctagaggccatgggctcctccatgaaaacgtctccaaagttgccatctctggcccactcatctctgaattcctgggggcagagaccctgtttcattcaactttatatcctcagcccctgacctgatatattgtgagcttgttaaacatttgctgggccaatgaatgacttgcttgagcctgtctcattaacatcccgctagatatcctacctctgtttagcccttggacctcacattcagcatgcatgtttctgagctcatcttcccagctctctccaggagctcctactcctgaatttccatttgaaggaatggccatagtgctcttctgggaattcaggattggaaccttgagtcaactttgcttttctctcttctttaccagcccctccattctcatcacagacatcagaggctaatgtctatggcttcaggaacaaggcaatatttattgagagcgtactatgtgcttactgtactgggtaccgaactggggacagggggtgcaactgtgtacaagagagacaaaatctgctctccagggagctaaaagtccagtgaaggaaggacagataataaaaatataagtgaatatttaaattattattattttaaaaattcaacaatattaaaaggagacagtatacatgcatgattaagcaatgtgtggttttttttggtactccagaaatttctgttatttttaattgatacttcataactacatatttcagggttataatttgatgtttcaatacatatatgtgttgtataatgatcaaatcagggtagttagtgtatccatcacctcatgcatttatcatttctttgtggtgagaacctctaaaagcctctcttgtagctattttgtaatatacaacaccttactgattgatcgattgatttaaatatgggatctcaccatgttgccgaggctggccttgaactcctaggctcaagcaatcttcctgccttagccttgtaagtagctaggattatatgctcaaaccacagtgcccagctcagaatgccttactgttaaccatagtcaccccactgtgcagcagaacaccagaggttatttctcctatctaattgtaactttgtacccattgactaacctctcatcttcccttccctccttctctctctcatctttgtaattgctgttctaatcactgcttctatgacatcaactttttaaacaaagattccacatgagtgagaacaagcagattttttctgtgtcttgcttatttcactctgggctcattcatgttgtcagacatgtcaggattttctttttttatggctgaatggtattctgtcacgtataaatatcacattttctttatccatatatccatttttggacccttaggttgattccatatcttggctattgtaaataatgctgcagtaaactgggagtgcagatatctctctgacatattgattgcattttctttgtttatatacttagtatggggattgctggatcatatagtatttttatttttcattttatgaggaactggcatactattttccataatggctgtactaattttcaataccaccaacagtgtgtaagtgttcccttttctccagatctttgccaatatgtgttttcttttgtttcctcgataatagccattctaacttgagtgaagtagcatctcactgtgggttttttatttttatttttatttttttttagacaacatcttgctctgtcaggctggagtgcagtggcgcaatctcagctcactgcagcctctgcctcctaggttcaagcaattcttctgcctcagtctcccgagtagctgggatcacaggcatgtgccaccacgcctggctaatttttgtatttttagtagagacagggttttaccacgttggccaggctggtctggaactcctgatctcaagtgatccacccacctcagcctcccaaagtgctggtattacaggcgtgagccacggcgcccagctgtcactgtggttttgatttgcatttccgtgatgattagtgatgttgaggggtggaagcgggtaagtaggaaaactcccaccacaactatagtgctagagtgaagtagggctgagactggggttgggccttccaaggcggaaggaagtcaggggtggaggccaagttgggctgattttcctgctgctgctaagagaaaaccaattaatggaagaaggttgggggtagggttaaggataagtatttgttgaggctctcatgtattggatgatgagaggaatcatgctatagctaaaataaagccaatgtcaccaatgcgattgtatagaattgcttggagggctgctgtgttagcatctgcttggccatgtcatcagccaattagtagaaaagatataattcctacaccctctcatctgataaagagttggaaaatgttgttggcagtaactagaattaatattgtggtgaggaaaataagtaggtatttgaaaaactgattaatgttcagatctgccttcatatatcatattgagaattctataatagatcaagtgataaatagtgctactagaataaacattatggagaattagtctagtttgaagcttaatgagagttttagggtttggattgttattcaatatcagtttgagatgatggtttcttggtctgtacacataaatgttgtgggaatgaggctaatggtgaaagtgcatgcgacagctatttttacatagtatggatatgagttctttttgtgagggttgataaaggtaataataattggtaaggttaaggagattaaggttattatagtaatggaaaaatacatgattattacttttatttggagttgcaccaatatttttggttcctaagaccaatggataactctcatcctctaaaagttgagaaaactatgttgttaggcatggaggcatgagttagcagttcttgcaaactttatcggtaaataagaagttgcggacttctattattagaccacaatctaacattttgattaaactatatttacaaggtataagtcctataataattttaggatttagagatagtaagagaattggtgaaaggtgtatgagtattagtatgttttctcgtgtaaaggaaggtttaatgctgttaatatagtatgttagtgttccttgttgtgttgtgacaagtatatagagggaataaagggctgtgattaatatattaagtcctataagcatgatggtagtgtttgatcaggagaatgaagccgttgttacaaggagttctcctactagattaatagtggggggtagggcaaggttggtgagatttgctgtaagtcatcaaaaggttactagtggaagtaatgtttgacgtcctcgagagagtaatatgattcagctgtggattcacttgtagtttgaatttgctaggcagaatagtagggacgaagtaagtccatggggaattatgaggataattgcactggtaaaacttcagggggtttgaatgaggatagccacagtaacaagtaccatgtggcttacggaggaatgtgcaataagtgactttagatcagtttgtcgtagacagatggagcttgtcataatatgcctcataaggataatatcaggaaaggataggctatatgttctgtcagagggctgaggatgagggtaagtcgcattttgtgtagccgcccaattttaggagcactgctgcaagtactattgagccagccttaggtgcttatacatgggctttgggaagtcataggtgaagtcagtataggggtatttttactatgaaggccattatacatgccaatcacatgagattgttggatcaggagattggtagttcttgatattaaatgttattattatcatgctcagtgagcctaggatattttgggcataaataagtgtaataagtagggggagggatcccactagtgtgtaaaataagagatatgtacctgcattgaggcgttctggttggttaccccatcgggtgataataattaagatagggataagtgtagcttcaaagagaatataaaatataattagttctgtggctgtaaatgctatgattagaaaaatttgtagggaaattaatatggaaatacagggttttttccataggggtgattcactggagaggtggtactggcttgctatagttataagaggtagtagtcaggctgttaagattagaaggggtgatgttagcggatcagaggagaaagttaatgagaagttgaatagattgtcgttgaattagttaaagaataatagggcaatgaagctggtgattaggctgtgggtagccatattgattcaaattgtataatttttagagagtcatgttattggtagtagtataattgtaggaatagttatttttagcattgaagtaaatttaggttatgtatgtagtctaagccatatatgttggaaattgaaagtagcaaagcaaggcctaccctggctttgcaggcagcaaatactggtagagtaatgggtattacatttgctagggtgaagtgtatatttaaagctataagggtatttactatgaataatgataatattattccttctaggcataggagggatgatattaggtgggactgatagactaatacccccagaagtgatatgataaatgctaatatgatacttatgtaaatagagggcatttggtaagtatgttctatcataatctaatgaaatcatttattttgccttaaactacttatttttttcttatacctgtggaccatttgtatgtcttcttttgagaaatgtctgttaaagtcttttgcccatttttaaatggggttatttgtttttttgctgttgagttatttaagttccttatgtattctaaatattaactccttgtgagatgtataatttgcaaatttttttcctattttgtaggttgtctcttccctcggtttttttttttttttttttttttttgccgtgcaaaagggttttaatttgatgtaaactcatttgtctatttttgcttttgttgtctgtgcttttgaagtcttgttttaaaaatccttgcccaacccaatgtcatgatatgtttgccctgttttcttgcagcagcttcatagtttcaggttttacatttaagtcttacacattttgagttggtttttgtttatggtgagaggtaagtggttagtctcatttttctgtgtatggatattcaattttcccagcaccgttttttgaagagattctcttttacctattgtgtgttctgggcacctttgtcaaaaatcagttggctgtaggtgtgtgaatttatttctgggatctatattctgttctattgatctatgtgtctgtttttataccactaccatgctgttttggtaactctagatttgtagtatattttgaagtcaggtggtgggatgcctccagttttgttctttttgctcagcattgctttcactatttggggtcttttgtggttccatatacattttagggtttttttccctatttatgtgaagaatgtaatttttttgtttgtttttgttttgttttgttttagagatggggtcttgttatgttgtccaggctagacttgaactcctgggctcaagcaatcctcccacctcagactcctgagtagctaggactacaggcatttgccactgcacttggcttgtcactggtattttgatagggactgcattaaatctgtaggtcaccttgggtagtatggtcattttaacaagattattcttctaacccatgaacacgagatatctttccatttatttgtgtcctcttcactttctttcatcaatgttttatagttttcagtgtttaatatttaagttaatgatattttaattgtttaatatttatttaataattttattattcaattattatttaatattaatttaaataatatttaaattaataagaaaaaattagccaggtgtggtggcatgcacctgtagtcctagctattagggagtctgaagtgggaggattgcttaagcccagaagtttgaggctgtagtgaactacaatcgcattaccgcattctagcctgggcaacagagcgagatcctgtctctaacaaaaagaggcaatttcaggaagtgatccctgccatgaacaaatcaaaacaggataatggtagtttcttggtggaggtaatatttcaggtgagactaaatgataagaaggaaacagacacaggaagatttgggaatagagagcaggtgcaaagcaagatgcagggattgagagcaggtaagggcctgcatcccttccctgaaaaatagtgatagttaaggatgaggggatgagagtagtcatactaatactaaaaatgatggtcagcagaacagtgtagccagtgttctaagtgcttgacccaatatacatcctttaatgctctcggcaacccctaagatggggactgttatggttcctattttagagctgggaaaaccgaggcatggagcagtgagtaaccagcctaagagcacacaatgaatgaatgatggagccacaatttaaaattgaatgtgttttcagaacctgtgcttgcttccagtgatatgtattgcctaccctgagaacgttctgctaaatgctatatgtcctgcaagcccaggctcaaatgctaccatctgcatgaagccttctctctccctcccaaccagaaatgcattctcctctgaacttgcagtggaaccttgacctttcatttggtgttgaccacattctgccttgtgttatgaatattgtgtatatgccatcctcggtaaatgtttcatatctgcattctaagtggttaacttcaggaattgtgtcatgtctatctttgtatctctcccaagactacagatagagagggcattgttggtatctgtggcatctgctgcatatttgttgatctaagacctggtacatggtacctggtgtcttttctaagacctggtgtgtggtttctacctcctgactgaaaaaagtttcttctctgggccaggcacagtggctcatgcctgtaatcccagcactttgggaggccgaggtgggtggatcacctgaggtcaggggttcgagaccagcctgggcaagcaatatggtgaaaccccatctttactaattagccaattgtggtggcaggcacctgtaatcccagctactcgggaggctgaggcatgagaatcacttgaatccaggaggtggaggctgcagtgagctgagatcacaccactgcactccagcctgggcgacagagtgagactccgtaaaaaaaaattttgttttcttctttgttgcagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcacacaaagcctgtttggttgtctcttcacaaggacgcgagtgaaacctccttcatcaggagcatttggggtttgatgtttaagttttgggcctctggtgtatttcatatttctgttttgctagaacttagtgcttgtgcaaggttaaattctagaatcaggaaacgttgtttttaggggccttcagcaagcacttcggaggtccctggacgtttacagctgtgagtcgtggatctacccagacatcagaacatagtcatccttggctcattcctcctccgtaggaggggtacacagttggtagagtgtgccctccaagatttcgtgaaacattatgcttgtctgtatttgtgtgtgcatgtctgcgtgaattttgagttcaggaataacaggtgatttgatcacagctatttgacagtggtgatagtcattgtatgccaagatgtttatgaggggaataggtagattgagtgaggttcatgtatattttgcctagttgtactcacctacaagagctgtaattaaatgtttctctctttccccttcctctcttttattcattcttttttttttttttttgacaaagtctcgctctctcacccaggctagagtgtagtggtgtgatcttggcttactgcaaccttcgtctcctgggttcaagcgattctcctgcctccgcctcctgagtagctgggattacaggtgtgcaccaccatgcctggctaattttcatatttctagtagaaacagggttttgccattttggccaggctggtctcgaactcctgacctcaagtgatctgcccactttggcctcccaatggaatgaaccattgtgtctggcctcattcattctttctttcataaaagtttggatactgccaaacaaaattaaagacatgaagacatttgataaattgttattacaaatgtgacagttatttaactactggtgtttatttttattagagtcatagcacctactggcctctgcttcagggattcacaatggtgttgggcaggttggatatcatggggcttacccttagcaaggcattctattccacctatgcccaggcggtgtaaaacatataagcatctggtacgctgtggtaccgacccagtgactggtataacacaatggttaaggttgccaaatagcaacccttaatcaataatgatcaaatctccacggaggtaaactaaactagaagtttacctcatacaggtaatttttgtgccatacatgattcacagaaccttccagatctgatgctttctgagtgatctggtcaatttgttctcaacctggaattcttgggcccttaggtgtttgtaaatttgttctcagagactctgagctctccaccttcatttttaagtgctttaattctttttggtgataatctttaaaacttcacagaggtgtgtcctggctctttggggcgactgcttcatatttgagtactgccacacaatgacagctcatgttctggggcctgcctacagaaagggatgaactttatcttggaccttttaatgtagtgtggatgggcgtctgtagctggaggtcttcaggtgccagtggttaatctgtttgaagcttgcttcactccaacctctcattctgtaacagactcctcctccaccgtccctcacctctgctgaacccttctagcagagggaactcaccacaagtgggggatggatttgggagcttgaaaggaccccaatgaccctgcagtccagccctcaaagtgctaagtgacttactgaagcctcgaagccatttctggaggatttgcaattctttgtatctctggatttgctgccctgtccctccaagccacctggtttcacttttggacagctttaagtgttctcttctctgttctctgtttctgccttcttagaaactatttaaaaccactcattttcattctaaactccggagccataccaaacaactgtaactgtcctctggtgagatttgcgttgtatgtgacaaatcttttaacttttttctgttagggtttcagttttgttggaagtctgcagtttgctcttaaggatgtgataagaatgtaacaacacatttgtatctttgaattttgaataggaaccaaatttttaaatttagtttagttttgttttgtttgagacagagtctcactgtgtcacccaggctggagtacagtgatatcatcttggctaactgcagcctctgcctcctgtgctcaactgatcctcccacctgaacctcctgagtggcagctggggctacaggcaggtgttttttaaaaatggaactcttttctttttttttttttttgagacggagtcttgctatgttgcccaggctggagtgcagtggctcgatcttggctcactgcaagctctgcctcccaggttcatgccattctcctgcctcagcctcccgagtagctgggactatgggcgcccgctaccacgcccagctaattttttatatttttagtagagacagggtttcaccatgttagccaggatggtctcaatctcctgacctcgtgatccgcccgccttggccttccaaagtgctgggattacaagcgtgagccaccgtgcctggccaaaaaaaaatggaactcttaatacattagaaaaaaaatgaaatcccttttaaaaagcactagaggaaattctgtgtttaaagatttacttatttggcaatgcaaacaactgtttatttcctaacataacttttgcaaatctgaatttttatgaaaagatttttaaattaaaaattttaaattgtactaatttttactttttaagtaattttgagtaggtaatatttttataaagatatttgtatggtttgaagataagaaaattaaaggtgttcaagaagagttttgcccccagttctgtccactgtatacccagtcctccccacttctgcatacatatttcagacaggtatttcttggaagaaagaacatatgctgtgaaacttacatgtctcagtaggtctcattttaagtgattctgtaaaatgcctgggaaatactggtgaaattctagaatggaaataactttgtgagattttgagctgagtactggtaaatagtagaaatggacttactaataaataagggaattttatttgataacttttttctgattacatagtaatgtatgttcattatggaatatttgggaaatacaaaaacacaccaagaaaaaagtatatttatttataattctattttgctatgtattttcccattattcactctgtgtttgtcacagatttttccccaccctttttcaatgagtgtatcctccatgtccccccaatcatgcatccagtaaactttgtcattactaccatctgtactttcactcacgtttcaattccaagcatgtccctctctgacaaccacctcccatcattccatcttgcttcttctaggaccttcccttcaaggatcttcagtgccaccagggcttccagttaggttgactgaccctatctattgtcttcccgatgtcagcaccgcccctcactccctcttcattcagcttagagtccatgtgtctttgttaaagtctcctgtacccaccaacacccttgcctttctgtcagttccactgaggtggtagaatcccaactctggttaatcctataaatccttgtcctccaaatttgtactggaattccaggatgtggctggggtaaaaaccttccatgttgcagacaggtctcgtttcaaaccaatgaccacaaacctccaatgggctttcaggggtttcggcaatgctgtgacatttccctggttatatcacccttttgcactctcggtctgttttactaatcatcgaattctctatgatctcaacctaaaaggttagagatatttcctgagaagccccaccttttctcttgataacccactatggagctgtcatttgtgaatttaagaagaaacacttgcctcttgactattttaaaacatcaaaaacaacatttaaaaattgaaggatgaggccggggtgtggtggctcgcgcctgtaatcccagaactttgggaggccgaggcaggcggatcacctgaggtcaggagttcaagaccagcctggccaacttggtgaaacctgtctgtactaaaaaaaattagctgggcatggtggcgcacacctgtgatcctagctacatgggaggctggggcatgagaattgcttgactctggcaggtggaggttgcagtgagccaagatcatgccactgcactccagcctgggtgatagagtgagactctgtctcaaaacaaaaacaaaaacaaaacctgagggatgagccacaaactgggaaatgatatctgccacgttgtataactgataaaggagatatatgtacatatactatatatataatcttctataaatccataaaatattaaacaatccaacctagatgggcaaaaatataaactagttcaaagatgagcaaaaaatatgaaccagtaattaaaaggaaataccaatgagcaataaatatatgaaaacataaccattctctttggtcatcagagaatttgaaaaatacagccacagtgagatagcattttatgtccatcatattatcaacatttaaaactctgtcagtaccaagtgtgggtgaagatacagagcaaagggaactctattacatcgatctaggaaatgtaaattgacacaatcattttagagagcaatttgcaatatttataaatgttggaaatttgcacacagtaaaatctagcaattccatttttggatctatgtcccaaaataaacttaaaaacattgttttgtagagacagggtcttgttatgttgtgcaggaaggtcttgaactcctggcctcaagcaatcttcctgcctcagcctcccaaagtattgaaattataggcgtgagccaccacgcctggccccaaaagaaatcttgcacaggtaccaggagataaggaggaagtgttagttttctgagcagcattgtttgtaaaagtacaaaaaaaaaaatgaaaagaagcaacacaaacaatctatatattcatcaagaggaggatagataaattgtggtatagtcatataaaggaatactatcaagtagtgaaataaaatcaattagaattattaggctgaaccatatgaaattgccattcttctagatcagaaacaaccaaatattggcaatttcatacagtttaaatatatgtatcagtaacataatgctgagcaaataatatatataatatgatatgatttatataatgttaaaatacacataagagtcttttatgttgcttataaattaatatgtatattgtacaaatatacagatgcatgggggtgatgagaagtttagagtagtagttgcctgggatgggattgggtcttggggggacaggggggaacatgccaatggggaggaattacaggggcttcaaatgcatcagtcatgttttatatcttcaactgagtgctagatgtggggatattctcttttctctttaatcctttttgcgtctcagtgctgattaatggaatttagccaccagattgggtgattttttggcttgttgaatagttggccaggtttgcagggaagctttgccctcttgggcagagtatgtttttccaatctagtaactgtctgtttttggtggtgatttctgtggctgtaattaatatgatcagtgttgccaaagcaaggataaggggtattgactcactttttattgccctgagccatccctgttgcaaaataatgatctggatataatctccagaccaggaagcaagctgcagatgggaaactcccttatgacacttctgaagatcccaaacagtttctttttttaatgtaatttgattttttatttatttagttttgagatggagtctcgctctgttgcccaggctggagtgcagtggcacgatctcggctcactgcaagctccacctcctgggttcatgccattctcctgcctcagcctcccgagtagctgggactacaggtgcctgccaccatgcccggctgttttttttttgtatttttagtagagacagggtttcactgtgttagccaggatggtgttgatctcctgaccttgtgatccgcccgtctcggtctcccaaagtgctgggattacaggtgtgagccaccgcgcccggcccccaaaccggtttctaacaaataagtgttaagtcaaggggttcctctacagaatcagtcatcttcaccatgacacccacaacgcccaaattgctgctggcattcctccactctgaatgcacaattagaagctcagcactctattggataaggctgctatttcaccatttgaagaaccttcaaaaaggtctttagagacagggcatggtggctcacacctgtaatcccagcactttggaaggccaaggcaggcatatcacttgaggccaggagtatgagaccagcctggccaacatggtgaaaccctgtctgtactaaaaatgcaaaaattagccgggtgtggtgatgtacacctgtagtcccagctactcagtggccgaggcacaagaattgctcgaacctgagaggtggaggttgcagtaagctgagatcgtgccagtgacactacattccaacctaggtgacacagcgagactccctctaaaaaaaaaattccttagaaacttcagaaggatccttccactagggcagaagggatgagagagtaagaatcttcacccctaccactcatgcctttctgaaggctcagtctggccacactgcaagggcacagtgagccagttttggcctggggcttcttgctgctgccaaattaacaactccagcccttgggtttagccacctgctgctgctaaaaatgttgctgagagtgatggagaggtgttttagttcccattttacagatcagaaaatcaaggcccagagaaactaagtagtcttggagataggagccatggcctctccacttgagttatcatcttgaaacatcaaggacaagccaactttatcaacagttttaggcctgtgagaaatgggcttggtttatcttgaagattgtaaacaaataaaaaaatagactgctccattactgatgagaaatatgagtcattctgccaggaattgaaagtacagctgcccataaaaaagctatgccggggtccagcctctccaggtccttgtgtgtgaaaaaccactcagtcaaagttccccttttatttctctttgtgctcagtaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcctgagattgacaacgccctacagcaagacggaaacctccctttacagcaccaccttgcgattctgcagccacaaagttgagacttctgaacgtggcactcttctgttcccttactgtttcacgtgtacctgtgtcatctttcttgtttcatcgtaaacatacttctaaaattcccattttctttatttagaaatagaactacaagcggatggttaaacaatttaaacaaatggtccatggggaaaagtgaatttcacactgtcccccaaactttcagtg

SEQ ID NO: 8 - DNA, 41037 bp, Homo sapiens
cgctttgaaatccaccctgggattcggaaaccgggtagaaaactacctggttcagcaaacgagaattcaaacagaggaggggcttggaggaggcgggtttcgacgaacccagcgcaagagtacgccacggcgcctgcgcatcccctgacgggtactttccattcgccagatgggggaagccagggggaagcaggttactgtttttgcatttctatcttcaaggaagaattaggttatgaatagttccgtgaatagtcaggaagcgctgtcctccaagttcaagattaaggaaacgtggcatgcacagctaaagcaagaggtgacgtcttgtatcttcccccgtttcctgggacattggtggtgtagcccattccacagactttcgctccctagcagcgggtcggagatcgaaggaacgggccaattgcggctgaaacgtctttggaaggaggaagggggtgagggagcatccctttgagtttcgcctcttctcgaggcggtggtgggaagggagacatacttaatactgccctcttaatccaacggaccttacatcgtgtagactgccgggagggcggcgggaaaagggcaagacgggagttggggaagggaaggagccaggaagccgcgcgggagggcgcgcgcgcgcgcccctttttcagcagtgtggcggggtcgcacgcacgcccgcctcggcggctgggcgcgatttgcgacagtggggggggcggtggaggtggcggcggcagcggcaactttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgtaagtgcagcttctggcagttacgagactgcggagtgaaagttttaaattcttttaaaacggggggcgcggggacgagcgggctgctgtggggggagggagaggtgtcactcaggaaaacgcgggcgtgcgggagaaaattgaaattgcctacggggattttgatgtggggccgagagcaagcaggaactaggcaaaggagagtggttctagtgattgcgtgggtctgagaagtctgccctgaaatcagtttgcatgtgatggggagtgttttggcctttggggggatttaaggggagagtgcgggtctgagattctagtagtttaaaaggcacgttagagacttttctaagaaagttggaaggacggggcagagttagggaccctgttaaaggagcgtaagggttgtcactctaagacccttgtggaattttcaggatggaaagtgatcttcgatttgcggagtttgggagactttattaaagggggttttgtgtccgcctccgtcctgtccgcggagaccgggtgcgcctgaaggtcgccttttctgtaggaggagccgaattgagaggatcgatttttgatttgggggtggggagtgactacctttgaggaagtaagagtgggtgatttcttctttgaacgtttttacttaagataaaggtgaggggggtggcgacctggaagattttgggcaacagtggtataggcagatgtatttaagtgtgggttcctggcttcgccaagtgcgcgatgttttgcaatcagatttttttaagctctgaaatgggtattcgtaatcattcggtaccaacatttaacccaactgagttttaattgactcgccagtaagagccgaattgacataaataagttttcagtttcatgttttaggttgataaccagtaaggtcaacgaagtatcttgacaatttattcaaagatactactccaaaatgtgattctccttctcatgatatataacaacttgtgaatatcttttaaaaaatccttaaaatgtttcagaagagtggcgtaagttcttcattttctcagtttggctagttttaggaataaatgttacatcttctacacgcagtttctaaattctgtcataattcctagctgaaacatataatgatgtcatgactaagattttcacggaaaagatgggaaaggattctttttgcagagacaagatagatattcttgggattgtcagtttgtgggatcttagacttcaaatttcagaaaagcttgggtgttaagtgttacttttgtatttttcacccgattgtgcgccccaatctcactgtacattgggatctaacattttttaccctcttctttttattatttgaagaccgttcattttatttctgcgttttcttaaatttctctaggcagattagagtattaagagcacagatgctggatccaagtgataggttaaaatttctgttctattagcttgacctcgagcaagagactgacataattgtcttagtttcttaaaaatgaggatggtggtgtatggtatttacctcatagagtatttgtaagcattaaatgagttaatatagctaaagtactaagaagagtgtctgccccatagtaagtactatacacatgttatttatttataataattactactactaattttatgattacatagaataatgtttctggctcttccacatacttaataatcaggcaaaatataatgaaactgtcagacctgtttagaatgaagaaacttgcaaaggacaaaataaagcttattttcttcttgcagacccttacaggaaaacatattctttgctgcaattttaaagctgttcaagaccaaatgattggattagttttgttttggttcctccatttggatagccttaattttgtgtgtgtgcgtgcgcatgccttggaagccttaatcttgtagagtcttctcaaaataacatttttagatgtatgaaatacaggatatgaggttacaaacaaattcaattataaaattgtacaccatgttataaaatatttctaaaacaaattttagatgtagtcctatactatatgtactttattagcacattaagtaacaagatctagcagcgggtctgatagtagtgatgggtataaacactttttcgaagtgtaatataaaaatacttgatttccattggtggcagagtcacaacttcagtaacattaagcatgtgttacctagataataatagaaggaagtgctaaattttaaaggtggcaaaaattaagatgcaattttttttccccatttgagttcacaagccttctgaatttcatccatgtacccctgacttaggggcagtagtaaggtaagggagtagagaacattgtataaaaatgagtttagaaaagataagggcaatagttttactcttgagggagccaaataatggcaaaaggccaaagcagatggggtgtgggggaatatgtttttgtgttagagttcaggtaacctgagcagttactactgttaatgtgagtcagagaattacaggcacatattttacatttattgtgttacctgccattttattgaactttttgagatcatatgactgcagagtagttggcttctgcgagagtactaatggatgccttggtagtaagatcagagggctgaatctggagacttgtctttttgcttaagcaaaagcaaagatgcagggaatccctgtggcaagatgcaggtgcaaattactgccctgtgtctctttcctcgttgggcaagtgaagatggtagtaccatgtctgttgcacagtatcattctttactttgagaatggaataggatggaggtcaccctgtacatatattagacactcagcaaagacttgattttagtttaaagataaaatggaagcatggtggctgtattacattttcatttgattccatcttgatttgccttgggaggagatgggtaaattaagtgatcagaagtaaaataagcaacgtgccctattaacgaatgttttgtgtggcctctgtattggcagctcagtgtttagccagaatgtaaagaaactgatatataaaaacgtcttagagtttttaaaatttcagttctctagtgttaaaaggtaattttacagaaaaaatggcaagtgaacacatgttgaaacttttactcagagggaaccaggcaaatgttatacagtaatggttaacccgcaaaatcaaaacagtacaaatttattaatatatggagtaaaggaatggagagatgaattccaaatggagacagaaacttttttttcccttgagtggaagggaagacattttgaacctctactgtagagacaaaatttacatgtctatcagttattcataatgaaaaaagagttgtggctgggcgcagtggctcacacctgtaatcccagcactttaggtggctgaggtgggaggatcctttgagtccaggagtttgagaccagcctgggcgacatcgtgaaactctgtctctaccaaaaattagctgggtgtggtggccagctcctgttgtcccagctactcaggaggctaaggtggggggaagatcacttgagtctgggaggtggaggttgcgttgaaccaaggacagagtgggtgacagagggagagcctgtctcaaaaaagagttgtaagatagctcaaagacatagtggagggctatagtctggtaacttggaaggatgtgctatatagataatgcatagttttccactgagatacagaattgttttctacgtttgatgttaattatgtgaatacaactgaaaaggtggagagaaaaagagattaaaataccacattttctatttctgtaaagactaatgatattcacattaaattacaattcaaatatttgttgagtacgtactgcttgctacccgcctattatttcatttatgatattttttaaccttctatataaaaccaactttaggaagcaataatttaaaaatagcccctaaagcagtgtttcctaggctgtttaataggcatttcatggaaaaaaaaaaaaaaaaaggcttcctctggaatgtattttagaactgctgccctaagatcctagattaaataaatcttttctttccaaaggagacattggaatctgtaatcaggaggtagtggaatcctcttctgagattagagagctgagattagagggccactcgtgtgtgagataaggtatgaattaggagaattttcaaggtttcctgcagtcatttcttttttttggaaggatttactttaattgtgattgagagtctctggagttctgatttatgagtattattactttagaacaatgagacagttttaacttgtaaatagcatagaatatatgtagcactttaaaaaaattctaaatgttttgcgttataagcagaatttgaataacaggattttaaaaagtgacatctaatgtagaagccattaacactcctgcttcaaacggctccccagctccatgctccagactgagcagcagtcaaatacattatgaagacatatacatcagtcagatttaagagtcacagctttgggatggaattaccagccaagagaccagttaggctttttcagcacttccagtaccttttgtaaagagctgtaaagattcactgatacagtgtattaaagtgactggaacagaccagtgccttattaaagacagtattactcttccattattctcattagtatttatttcattttcatttttgttgaaatataaaatatctacaaaccttctaacctgtagctggattatgtttatccttatgtggaggcaagaatacatttttttcttcttgtagaaattatttctcttaggtcagtcagcatcttcccagtagagttatttactgctaaaaacagtattgctgtttcatgtaatttttcctcatttactgcttacaggatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggtatgtgcaaaaaaagatcctttgggctgaatgctaggcttcagaaattatttctctgtggcacgcatttcgtactcaggatactctgtcaagttgtaaatattttaaagttacaatgttttctgaagggtttttttttttgtagttcagactgcgtatctattttagtccatcccatgtttagttttttggttttgttttttgttgttttaatttaaatatgtgacagtgttgcaggatgtttttgctttattgtttgcattcaaattataagatttgggtaactattactctttatattttagtaaaacttaaaaaacataagccacttctggcatcagtttttaaaaagaactgaatgtaacccattaactttgactaagtataaattgaaacagatgttttactttgtacagtttctgtcctttgttttatttataactgttttcaaagaaaaaggtgtaaaaaatttttaaactttttaatattaaatatttagggaaaagggggttttggttatttaaattaatctgtccccaatagtatttttatttactttataaaaggggttactggtgtttaagatattttcttttatatatgtccagtttgttttttaaatgtgaggctatttttttctatactgaggaaaaatgtgtattatctcatacatatgtaagttaaaaccttttctaaatatccaaatatattttttataagtaaagttttgggaaagcataagaagctatgactatgacatttttctgtctgtgtagcaaaaattcgatgctcagtgtgtcagattttgctcctgtaaaaggagagaaattaatctcagcatattttttaaaagtcaattatagtttcatgtgcatatttatttacattaacgtactacttttaggtactgtacctggaagatgtttttagctgccttttatacttaaggcagtatttcaaaatcctaaagctgtggcttttcaaatgatgagaaaacgaaagacgtactttaaaagtgaaaacagtgccttaaactgcatctgaaagtcagtgttaaatgccagaagttggccagtaaaatcctaaagctgaaaaataactttgtgaacaaaagtgcataattgttctttgtacatctcctatagcctcctggtaactgtgcagttacagtttatttcttcccctagtccccagtgttcagatattctcattctgactaacagaaaacagtgatttgaatggagtctgctatgcttcactttacaagggaaaaatttagccttataaaatttagtgaatgccagagaagctattaaggccatctgttaatttcctgtttcagaaaaataaattgtgtccttttgtatccaccaaaattatccagtttattgtgattcagaatatgattggcttattaagaaaaaggcaaatattataagtgttttcgtaggtaagcggttattacctaacttgtgatttcagcctttggttgtgataaaactttatcatacacaatattttaaaatgtgaaaactagactagtagacatcttttaattttagtgtcaaaagttagcttatgtatgatacacaaaataatgtattgcattttggaaaaaagaaggggataggttagtttactgtcattttctggtttgtaagatacattaatcttttcttatttcatgattattttataggaagatcataaccaaccattgtttggagttcagtttaactggcacagtaaagaaggagatccattagtgtttgcaactgtaggaagcaacagagtgagtgttaaggggtctatttagtatttggcttgatttccagatctggtgttaatgtaatattgaaatagaataatttcaaagtgcattttgtgaagctggtttagcaatatgattctttcatgtaagagtgaaggtttctagaaattaattaaaactagtatgcatggctgaaaatacatctatatttaatatattacccctaattatttatgaaacaggttttatacttgtatttgtcttcataaatacttggttgaaagaattggcgtcctttttttttttttttaattggcgttctttttaaagtgattttggtatttatcattcaaatagcgtaagaactggctgtgatttttttaaaattaaggtaatgaatggctctataaatgaagcataaatccagtggatttaaataagttattgagatgttttaattacttgcagtaaacatttgagtttgctgggtttttttgttttgagacaggtagtgtttggtggtgattgttgttgttgttgttgttgtttgtttttgagagagagagagtcttactccttcctccaggatggagtgcagtggttaatcaaggcttactgcagcctcaacttctggggctcaggtgatcctcccatgtcagccttctgagtagctacaggcatgcactaccatccctggctaattttttttgtagggataggttttcaccgtgttgcccatgctggtcttgaactcttgggctcaagcaatctacctgccttggcctcccaaagagctggggttgcagtcatgagccaccatgtccagccttttaaggaaattttataatgacatgtaaggctctaggccttttactatttgacaaggtcaattcattgaaactctaaatatttttaagttaccactgaagttgataacatgaaataatagctttttttcttctgtttttggtgtttagtcaaatgtaggttttaagataatgtagtctgcttatagttgtttagttcctagattctttgaaaacaacaattcagaggaaaaattttgcggttttaagaaaaggttgaggttatttttttcctagttgggaatgtagtgcattaattaaatttgagtccacttttaagacaccactgtaaacctaagttaatatttagctttgatagtattataattggtatagtttgtgctccagtgtgctgattgcagtgttttaggttttctaacaaaaagaatccctatttttatttaaagtgacataaaggggtgtcatatagtttattgaattataaaaagttctgctgttagaatttctttaaaaggaagaaagaaaacaaaaacaattaccacataagacataacctagttagcagccatataaagaattttttttgaacattaacatagaggagataatgaattaataggttgtgatgatacacaggatcttcagaggtcttcagtactattataaaataataataggtttttgctaatgtgactgactataagctataagaaaaatggggccgggcacagtggctcacgcctgtaatcccagcattttgggaggctgaggcaggtggatcacctgaactcaggagttcgagaccagcctgaccaacgtggtgaaaccctgtctctactaaaaacacaaaaattagctgggcatgatagcgagtgcctgtaatctcagctacacgggaggctgaggcaggaggatcactggaatccgggaggcagaggttgcagtgagccaagatcatgccattgcactccagtctggacgacaagagtgaaactctgtctcaaaaaaaaaaaaaaaaaaaaaaaaaaagaaaatggaaagaaatttataaaagtttagtattacaaaattgtgtatggtgtatgtatagttttaattttagagtatgcaacaaatgaaaaaggctatcatacatgtgaaagttaatgtttgattatctgtacccatgagaaaataattcattaagcaaattgtagacttttaaatatgtaactaatatgtaaatactccaaaactatccaaagacttatttttatttgaatttttattttttatggtttttttttttttttgagactgagtctctctctgttgcccaggctggagtgcagtggtgcaatcttggctcactgcaacttctgcctcctgggttctagcgattctcctgtctcagcctcctgagtagctgggactacaggcacatgccaccacacccacctaatttttgtatttttagtagagacggggttccaccgtgttagccaggatggtcttgatctcctgacctcgtgatccacccgcctcggcctcccaaagtgctgggattaaagacatgagccactgtgtccggacttattttattttatttttttttgagacagagtttcgcttttgttgccaggctggagtgcaatggtgcaatctcggctcactgcaacctccgcctcccgggttcaagtgattcaccagcctcagcctcctgagtagctgggattacgggcatgtgccaccacgctcagctaatttttgtatttttggtagagacagggtttcaccatattggccaggatggtcttgatctcttgacctcatgatccgcatgccttggcctcccaaaatgctgggattacaggcgtgagccaccgtgcccggcctaatatttattttttaatagagatggggttttgctatgttgcctaggcaattgaatggatgaaatataagtttaaaagattggaaatcgaaacgactattactgcaatatttaatatgctctgtgtattatgtaaaacattcagctttataatggcttctttaagctcacaggaggtattttaaggcagtagtttctgtagtatatttaagataggattgcgattaaaatatgtttaaaagttggagagagtatgttttctatacttgagatgaaatttactgtatttttattttcattaggttaccttgtatgaatgtcattcacaaggagaaatccggttgttgcaatcttacgtggatgctgatgtatcctttcctgggtttttaatatctttagtcaaaggaatttattttcaataagtgcaccaaaacttttataaattaatcatttccctaaagttattgttctttcttaaccgatttcttcactatcacccaagagaatcctgtatctagttttcctgacccttagaaatccattgtggtatgtgtcaactcagctaggcaaaaagaaaaagaaaagaatccattgtgggatggatgtgctggttgggtgcagatgtctatagagataggagcattagaaatctagtaatagaaaatattagcaaagactgattaaaacctcctttttctttgaccttgcctagaatatatcatttcattgtagttataatgatgaacttggcttgtgactggtagtcattctaagtatttgatcaacgaagcctaggaagaaaaaaaaagtttaggaaaaataaaatatataaaaataaaataaaataggaaataaaaattgcaaaacaggttcataaagaaacagaaaaatttgaaaagcccgagttagagcggtaaaagctaagtaataagatatttcttccagatccatttgaaaaacctagcaaacaagacaaggcaaggacattcagtcttctctaaaagatattgaaatgtgacctgttgttgtattgagactgtctcacaaagaaaaaagtggaaaactgaattgttcttttttagatatttatagaggtatggggatagagcagaggttaaactacagcgtgcaggttggtcacctgtttttgtaaagttttgttttgaacacaaccatgcccattcatttgtatattttctgcagttattttggtactgcaactacagagttgagtagttgtacaagcagctaaagagtaaacaaaattgagtggagagactgtaattttgtttgatcatttgttatggattttagacctcaaatcaccattgtatatatttggttgtataaggaaaattgagaactttggtgtcaaaaactttagcagttctttataagtttctattataattattgacatgtttctttttcaaaaacattatgtttcttaactgtggaatttcttaggctgatgaaaacttttacacttgtgcatggacctatgatagcaatacgagccatcctctgctggctgtagctggatctagaggcataattaggataataaatcctataacaatgcagtgtataaaggtgggtttttctggttaaattgtagatctgcttcttttgaatccacaactgtaaaaacttgtaatgttaaatttaaaactaatggtatgaatgtaacatttctcatttgatttgtacttttcttactgctctctttggatgagtcttttgagacgtttgtcacatttgggtaatgtaaattaaggaataagtgggaaaatgttaatatttgtagtgctttctttttaaatcatttccctctttcacccttgtcatggtttactttgagaggctctaaatgaacaataagagggagtccattttccaagacacctaaactggaggggtgttatcaaagggaccttgtaacgaacataaaggtgaagcctaggaagttgataagaagacgggtttttcaaatcactttcatcacctgtttttaactgttgggctacatcacactctcctgaggatgcttaaaaccctacgcatattggagcctccgctaatccgatcagaatatctgcaggtggagttttgagcatctttttttttttttgttctgagacagattctgactcctttgcccgggctggaatgtagtagcatgattatagctcactgcagcccgtctcctgggctcaagcgatcctcctgcctcagcctctcaagtagctggggccaatttttaatttgtgtgtgtgtgtgtgtgtgtgtgtgtgtgtgtatgaagatagggtcttgctgcattgctctgactggtcttgaactcctgacctcaagcgattctgccttagctttccaaagtgcttggattaaaaacatgagccacccactgtgcctggggtcttttttttttttttttttccttttcacctcaagtttgttgggtgattttagtatgcagccaaggttgagaaccactactttaagtgaaactatttttacattctctaaagatttatgaaaaaaaatttactgattttgagataggaaacttgaaatgttttaaatttattgtagcactatgttggccatggaaatgctatcaatgagctgaaattccatccaagagatccaaatcttctcctgtcagtaagtaaaggtaagtgaagcaaatgtttcttgagtctgtgcaatttgtcagaattaagatggagtcactaatgtcaagaaaaccctgacaaataggaaaaaccatgagaagagagtccacatgcttgtatgtctgataataaaaactcacaaaaaaacacaaccacaaccttgcacaaaggccatcacagccttacacagaaaatactggcagtaagtgcctctccatcctgagactggcatcacccttgttactgattttgtggccaatcttatttcaaaacaattatgtaatccttctcatttttttctttaaaaacctctgtctttcctttacgtctcggagaacacacatagtttactttggcatgtacattctcattgcagtgcattatttccatataaacatcttttattttagagagcctctctgttacttaggttgacaggtcctgttttattttaagtctagtatctgttagttatttttcctgatcttcttactcctcccaccctctaccctccagtaggccccagtgtatggacagatagtgttctaaggaaataaagccaaattaaaaaaaaggttataacagtacattttagtaggaaaatcccaggctatgttagcatatccaaatcattttgtccaatcatgtaataataaatactacatatgaaaattcatattgcttttttattttttaaaaaagcttttgttttataaaggatttcctatagaatttcttaaaaatgctacgtttttcaggataagttatttgaaatattcccataaagggaaagcattgcattttggaaatcactacctctaggaagagttgattactttttcttgtctcttgataacactaattggggctcagatatttctgaacaactgtatagaccgtaatgcctcacttgttctaaatattacaactttttttttctcttttctttgttttttggtttttttttttttttttgagacaaagtttcgctcttgttgcggaggctggagcgcaatggtgcaatctcggctgactgcaacctctgcctcccgggtttaagagattctcctgcctcagcctctcgagtagctgggattacaggcatgtaccaccatgcccggctaatttttgtatttttagtagagatacggtttctccacatgggtcaggctggtcttgaactcctgacctcagttgatccgcctgtctcagcctcctaaagtgctgagattacaggtgtgagccactgcgtcctgcctctatttatttatttatttatttatttttgagacagagtcttgctttggcgcccaggctggagtgcaatggctctatctcggctcactgcaacctctgcctcctgggttcaggtgattctcctgcctgaccctcccgagtagctgggattacaggcgccctccaccatgcctggctaattttttttatttttagtagagatgaggtttctccatgttggccaggctggtctcaaactcctgacctcaggtggtccacccgcatcggcctcccaaagtgctgggattataggcgtgagccactgcgcacagcccaacatcacaacttttaaccctggtcttcctctattgtgtcagtaagagcatttttaaaaatcagaagtttgagcatgaataagaattttgctccaagtgatactatcaagaaagtaaaaaagcctactcaaaaggagaaaaaatatttataaatcattctgataaaggactttgatttttattttttgtttttggagacagggtcttgcccagtcacccaggttgagtgcagtggtgtgatcatggctcactgtagcctcaacctaccaagtagttaggactacaggcacgtgccgccatacctggctaattttgtaaaaaatgtttttgtagagatgaggtctccctgtgttacctagactggtcctcaaactcctggcctcaagcagtcctcctaccttggcctcctaaactgctgggattacaggcatgagccatgattcccagctaataagggacgtgtatcaagaatttttatagctcaacaataaaaagacagcccaatttaaaaatggccaaaagttctgaatgacatttcttcacagagcatacacagatggccactgagcacatgaaaagatgtttaacatattaatcattaaggaaatacaaatcaaaaccataatgaaataccacttcacacctacttagggtggctgtaataaaaacgttagatactaacaagtattgactggcacaagaagaaatcagagccctctcagacactgctggtgggaatgtaaaatgtaactactttgaaaaacaatctggcagttcctcaaaatgttacagagtcactaatcctagatgtttacatatgtatgtatatcctagggttgtgtgggtgggggtgtacatatgtatccccaacagaaataacatgtccatacaaaagcttgtacaaaattgaaatcaaggaatcatttttacagcactgttaattttcacatgtattactacctctggggtgtttatgtgatgcatttatattcacagacagaatgaacattgttatatttcaagcttacatgacgtgtctttgctttacattctttcttttttttaaatactgttttagagacaggatctcactctgtcaaccaggctatagtagagtgatgtgatcacagctcactgtagcttgagctcctggcctcaagcaatgttcccacctcatccttctgagtagctgggactacatgtgcacaccaccatgcctggctaatttttaaaaattttttgtagagatacggtttcattatgttgtccaacctggtctcaaactcctggcctcaaaagatcctcacaccttggcctcccaaagtgctgggattacaggtgtgagctactgctgtacattctttattaatgtttaatataacattgctcaaattatagctgcataatttttgaagagggactgtcattctataaaattgtgcatgatatatgtagttatgttttcagcttactgtaaaaatcataaatctcagtcccctttcaattttttaatgtgagtatggtgaagggaaaagctagtatcttgttctgtgggataaaattgcttatgtcaaatctgtattttatttcaaaagtatatttccatcaaattaggttatttaaagaaagttatttgagataaatatgcttaaaatatttttcagaccacatgaatatttctgaacttactgtcttagtccactttaacctggcattagaaagtaagaacaagaaattgaacttgaagccttttttttttttaatatataattggaattaattcattcataagagtggtactctcatgacctaacgcttctcattaggtctcatctcccaacactgctgcattgggattaagtttcccaacctgctttttcgggggttcatttaagctgtagcattctgcctctagcccccaaaattcaaatcctcaatcagatatgggtgagactcaaggcaggattcctgctgaggtaaattctccatctgtgggtctgggaaatcaggcatcttatctattttcaaaatacagtggtaggataagcataggatagacagtcccttccaaaaaggagagataggcaagaataagggtaactggtcccaagtaaatccaaaactcaacagaacaaacaagattaaatccaaggcaccagaataatcttccttggctccatgttttgccttctgggcatgctgggtgtggagtttgggccccagaggccttgggcagccccatctttatgggtttgccacgtgcagcccacatagcatcttatgagttggagtcgggtgcctgcagctcttgcaggctggtggtgtgccctggtagctcagcagttctgggatttgggggatggctttttccccatggctccaccaggtgttgctgtagtaggaactgctgtgtggctctgcccttctgaaaagtttctgcctggagccccaggctctttgtgatgtcttttgaaatctagagaggaagccgtgcctccacagttcctgcattctctgcatctgcagacttaacaccacatggacactgccaagatttgctgcttgtaccttcagaagctatggcctgagccatacttgagccccttcaagctatggggtgaccaaagagcactgccttggaatagggggagcaaagtgctgaagtggccctggacagtgaatgtagaggtcccatgggtgctactctggaaaccttgccctcaaggtcttagctatgtcttgaagatctctgaaatgcctttgtggtcattatcccattgtcttggtgaatagaacctgccttctcttccctattaatctccttagcaattagtcacttagctacatccttaatattctctctcaaacatgcttttttattttatatattttttgaagagacaaggacttgctatgttgcccaggctggtcttgaacttctgggctcaaatgatccttccacctcagccttcgaaagtgttgggattacaggtgtgagccaccacacccagcctgctttttttttctttacatggccaggctgagagtttataaatgtttctgttttgctttcctttttaattacaaatttcacctttagatcatttctcattttatgataagcagccagaagaagccatgcatcactgtgaatgctttgatgctcagatatttcttctgccaggtattggattcattgctcttaacttctgccttccacaaagtcctagggcatggacacagtcctgctaagttcttcacaactgtattgcaaggatggcttttatttatttatttaatttatttttttgaggcaaggtctcattcttgtcacccaggctggagtgcagtggcacaacctctgctccctcacaccctctccttcccttttgctgtgagacgattcagcatgaaggccctcaccggatgccggcaccatgccagtgatccttccacttcagcctcccgagtagctgggactacaggcacatgccaccacaccccgctagtttttgtattttttgtagagatggagtttcaccatgttgcccaggctagtctcgaattcctgagctcaagtgtccacccacctcagcctcccatgctgctggaattacaggcatgagctaccacacctggcctggctttttttttttttcttttaaagacagggttggtctctgtcacccaggcagtgcagtggcatgatcatagctcactgcagcccaaaactcctaggctcaattgatcctcttgcctcagtcccctaagtagctagaactgcaggtacacgccaccacacctggctaatttattttctgtagggattgggtctcactatgttaccccggctggtcttgaattcctggcctcaagtgatcctcctgcctcaatctcaaagtgctgggattacaggcatgaaccatcacaccctgccaacagggatagctcttactccattttccaataacttctcatttctgtctgagacctcactgaatgagaccaacctcattctgtctgagaccaacattgttctaccaacattctgatcacaaccacttaagtaatccttaagaagataaaggctctgcctgaagctcttgtcttcttttcagccctcactggaattaccctcaatgctccactcacaccaatataggctttttctagcctgctcctccagattcttccagcctctcctcgttacccagttccaaagtcatttccacattttcaggtatttatagcaatagtcccgtttctgagtaccaacattctgtctgagtccattttgtgctgctataacacaataccacagactaggtgactgactgatggattaattaatttcttttctattgctcaggcttcactaatttttaaattttttgttgagacagggtcttgctatattgctagggctagtctcaaactcctgggcttaagcagtcctcccatcttggccttctgaagtgctggggttacaagcatgagccaccgtacctgactgggtgatttataatgaacaaaaatttatttggctcctgtttctggagactgggaagtccaagaacatggtgccggcatctggtgagagccttcatgctgaatcgtctcagcaaaagggcaggagagggtgtgagggagcaagagattgaatttatagcctcaggcccttttataatcagtattaatccatttgtgaggatggagcccccatgacctaaatacctcccattaggccccagctcacaccactattgcattggggattgagtttctagcacatgcttttgggggggcctattcaaactatagcacttacctagctaattctacatctgatgtaaacattttaagttgctatgtaatatggattccatttttaggctttactgtgcataacttacatctagactttagtagtttttctttcacaagatgttgaaagttcacagtaaataaaaaacattcgcctaatttttgtatgtttatactagatcatgctttacgattatggaatatccagacggacactctggtggcaatatttggaggcgtagaagggcacagagatgaagttctaagtgctgtaagttggaaactgcagggcaatgactttcaggtttacatagctgtgaacagtctccatggaactgtttccttataagaaagtgtgtttcatgtagcctgtcaggcagacattcacttacatttgacatagaagattttaatctccagatgaaggaataaaacaagtaaagactatatttatttatttattttttaaattacttgcactgtataccaatccctggagtcttatgagagcagtatgatcttgctcctttccttttaatctaaaatcactaagttaatgtttgttttgccatttcgcagttattaaagaaaaaaattaaactatgtagccattaaagtgcttttccatcttttgtttgaagttgaaacataacgttttttgctatttggaagtgttttattgtgctcacactgttttaggtaacttatttctagccattctctttgggtggcgtggtataatacaagaccagtttaaagataaataccacctttatattgatgtattgtaatccattggtccattatacaagtgtttttagttaggtttcagattttaacattatttttgcttatgttccatatttagctcatttgattcctgtagtaatttcacatctcttaggttgttttccattaaactatgtaaaggggcaccatattttacagcatgtaacattttagttgaaggtactaaaatattcctatgttgaagtttggattcctttgtgagaatcataccttccttcgaataccttgtcaacttggatttcctaaaagttgcagtagcattctacgtctggctttatgtgtgtaaaagccaagtgaactgttctttattaataactccaaattagtggtattgtctcgaaggatgtcttgttgctgttgacagtgaggtaattagaagtaccacaactgtgaattcaataaacatcaagcctaaagttcttaggctcttataaaatggtgctcataattaatgcaaaggctggattaacatatagtatctaggttagtaaggaaaatatactccttcaatagaactctctactgttatttcttagaatgagagcaggagacagtatgtagctcttctgtgtaatacaggagttcactggaggtggataggtgtgtgagattttcattactcattatgtgccttttgctaaattaaatagcatctctgggccttagtgtctgcctatgaaatgaggttgttacaatagatgatctgttacatgcctgttaaaaattagtaaacagcaaatgaaaaaagttaaaatctgttttttattagacttttaaaaattcacttaaaagtgaactctaaaactaacttcaaaatattttgacttagaattataaagtaagatgtcagctctttaaggattcatgtattttcacatgcacatgtcagtttcattggttggttgaggttggataggaaaagtaatatcactattcagctctttgtgtcagaataattattttaacttagtattcaatttaccttcaaaataagcaaaataaatattttagtgtaattgaatagataaaactaagtttaagtaattttttcttggtttatacattgtaaatgctcttatattccgatgttgacaaactaattaaagctgtaaatcttgaaagtagtaaactctgatttatggcctatttagatgaaacccaaaatgtagtttgtattgtgatttgaaatacagttttcactatgttgcacattaggcaaaaattggataaatataatttggagctgtaatttatataaaactttttggttttgcatacaggattatgatcttttgggtgaaaaaataatgtcctgtggtatggatcattctcttaaactttggaggatcaattcaaagagaatgatgaatgcaattaaggaatcttatgattataatccaaataaaactaacaggtaacagttgtggtatttgaaacaatttgctatgttgtgctattgaatataagttttattttttcccaaaattgctatataagccccaacaatgagtttagaagaccttcttttaactttaagggacaatttacatactgtaaaattcacccctttaagaagtcctttatttgcagtgtttgtggcttagttttcaaaatcccctttaaattgtgttgtcatcttaacttagtagcacattttacttatttgtattttggtatgcatatgcttggccttttaagttataaatgtaaaagttttaaatcacttaagcttattatggactagggagagtaaaggacactttagaataatgttaactttttttaaatgatgctaattctaattcaagatggtaaaccacagttttaaacaatggagttcttagctctaattcatgataatgtttttccctaaatgatgctcacttgattaaatggagagaattcaaatgcaggagcctcacttcatggtactataggttggggaattttgcagttttcttagtatatttttgaaatgtctcaattcttaatgcagtaactgtctttagaatcttatcaggctgtcattaacactttcactataaacgttgtatgtctgcatgttaactttgttggcacttttgttttagcaaagagctagaattcattttctggttatcaagccagattgttaatagattattaaatttgtaagcatcagtaaatatttcaatgcactaacattcatcagacctaagtgtcctctaagaattattaaaagttttacctttctcctttaaaacaccaggagctagtaggacaatgttaaatttatatttttagattattttctagatatctggaataaatacaaactatatttcagagttttcaaaaaataacagttgtactcgttttttctttgagagaggtttggccatacaattatagtatgtatttagctaaaaagcaattaatataattatagcagagttaagaatttatatcagatcacgaataacattttaatgtttcaacaaaatatcccagaatttgaattggaaggattgttttgagttgctccaatccaaagtgcttttttacatatctgagggaaaaggtaaagagaggacatatgaattgcctaagacaactaattcatggcatattatacttatacagctatttctgatttaaaactgagtatattaggaatgttaagtgtactgttaaataactccagaattaatagcagcttgttttgtttcttctcacaaatatctctaatgaaaacagtgttgccatttagtttcctaaatacagaaattatttggaaaagtcctaggaaattttattttgttctatttgtttttttgagacggagttttgctcttgtttcccaggctggagtgcagtggtgcaatcttggctcactgcaacctctgcctcgcaggttcaagcgattctcctgcctcagcctcccaagtagctggattacaggcggccgccaccatgcctggctaattttttttttttttttttttgtatttttagtagagatggggtttcaccatgttggctagggtggtctcgaactcctgacctcagatgatccacctgcctcggcctcccaaagtgctgggagccaccgcacccacccccacttaagaaattttaaattcctgtaaggcatcattttcagaaattattgctcaaggcaggactgtagatgtatctttagcagactttggaatgatgtttagttgttcctggaaagatgactatcttttgaaatagtgtagatatattgactttcatagattattaatgcttaattttaaggactgagtaggtagcttagtatattttcagtgagaaactgatcaggcctttattattggttagggtacccagaattgaggtgattaattttgggttatatatagtaaaacgcaggaaactacaatgtttataaacaaagtatctatcataggacaaagataaaattggataataatggagaaaaataaacaaaagtggaatgagactttagctttcaataaatagataaggtggttggttatgtaggaacacagaggaattaatagtcttacattttgtttttccaagttttataaatccaaaaatgaaaaagagtatgattctactataattttttcttttaactttttacatttccattcttccttcaggccatttatttctcagaaaatccattttcctgatttttctaccagagacatacataggaattatgttgattgtgtgcgatggttaggcgatttgatactttctaaggtatggtaactgcagttaagctgtacttccatcgtgtgtgtgtgtgtgtgtgtgtgtgtgtgtgtatgtgtgtgcgcatgttggaacttggcagggagcactttatgtagtttattaaattgaatggcagctgggaagttgccttttttaaagtctcatattttgatatatttagaaacttgttttaagaataaaacatgccattgaattataattctttgtgctccagtaagatgagtatagttttataaggtgatagtattctctgatagtcagtattgttacaagataaccagtaactaaagccaacagaattggcttttgtttttttgtatctctgtgactattttagtaaaattttatttataaaaacaggtggctggagttggcttatgggctgtagtttgccaacccctgcccctgttgatggatttatacagatgctcctcaacttatgatgggattacatcgtgataaacccatcataaattgaaaacgcatttaatacacataacctactgaatatcagcttagcccagcctatcttaaatgtgctcagaattagcctacagttgggcaaaattatctaacacaaagcctgttttataataaagcattgaatatctcacatactgcatactgctagcccaggaaaagatcaaaattcaaaattccaagtacttcaaaattgcagctgttttgtaccattttggtaaagttgaaaaattgtaaatcagaccattgtaagtcaaggccatctgggtgtgtgtgtgtgtgtgtttgtgtgtctgtgtatttttttgtagctgataatttagagaagctattggtgatgttacatgagcatttaggattatcaaatttggtgaaattgctgtccggtttcttttcttgatgtgaatttcaggccacttcacattttcttgggcagagcctgatttacttttttcttggctttatgtgtaaactgtttttttcttttttctttaaacttttgaccttcaaataacttgattcataggatgtttcaaagattgtgcagagaggtcccatatgatctttatccagaatccaaagtttatatattatataactgtaatacaatatcaaatccagaaaattgacactggtacaatgtgtgtgtttagttttatgtcattttatcacgtgaattttgtcatttcaagaatggtacagtttgggaccttttaagattgtttttttccactcaaacccttgagatccatccaggttgttgcctgtatcagtagttctccttttttattgctgagtagtattccatggtatggattaccatagtttatgtaactatctatggtaggaggttttggtcatttccagttctgggctattgcaaataaagctgctaatcagcagttgtgtccaggtttttgtgtggacttaagttttcatttctctgggtaaatgcctaggagggcaattgctgggttgtggttaagtttgtttagttttttaagaaactgccaaactattttccagagtggccgtgccattttacattcccaccagcaatgtatgagagatccagtgtctccgaatcttcgccagcatttggtattgtcattattttttattttagctgttctgataggtgtgtagtgatatctcatcgtggtcttaatttgcatttccctgatggctagtgatgttgaacatctttttcatgtgcttatttaccattcgtatatcctttttggtgatgtcttttcatatcttttgctcattttctaattggattggttttttgttgtgttttttttttttttttaactgttgagttttgagagtttgaatatattctaaatatgaatcctgtatcagatacatagtttgcaaatattttctttcagtctgtagcttgtcatttcatcctctttaatagggtctttcacagagcaaatgtttgtagtttttattaaatccagtatattgattttttaaaattattttatggattatgcttttgatgttttgcctgagaactccttaccaagctatagaccttaaagattttctcctgtgttctcttgtaaaagttttatactgctatgttttacattaaatgtgtaatccattttgagttgatttccttatgaaggtgcgaggtttaggtggaagttcatttttctcttatagatactcagttgttccatcagcatttgttggaagactattcttccgccattgaattgcttttgcacctctctcagaaattgtttggctgtacttacgtggggctgtttttgattttcctgttctgtttcatctgtatatctgtccctccaccagtactacatacacagtcctcattattgtagctctataattattcttggaatctgatagatttttcccgcttttatttttttcataattgttttgagctattctaattcctttgtctttctgtgtgtaaattttagaataatcttttctacatttctaaaaatcttgctgggagttgttttgaggagaaggagtttttaactggatttgtattaaacctgtatatataatttcaaggagaattaatattgtgctgagtcttctaatccatgattgtggtatgtctcttcatttatttacaacttctttgacttttgtcatcagcattttatagtttttagcatataagtcccatttttgctctgttagatttatacctaagtattttttaagcaattataaactgttttatatttttattttccatttttatgtgttcataactaatatatagaaatataattgatttttgcatattgatcttgaatcttgtgacctagctagactacatattcaaggtgtgttttgtgattttctctgtagactatcatgtgatctgcaaataaggacagttttatttcttcctttgtgatctatatgccttttctttttttgccttattgcgctggtgaactttcagtcctgtgttgaatagcagtgttaggaacagatattcttgacttgtcattcagtctttcacaattaagtatattagggtttgttttgttttgttttgtagatattctctatcaagttgggaaagttgagaactgtttcctgttcctaaatttttgagagctttttcatgaatggtgttttgtcaaatgctttttcttcatcagtttatatgctcatatggtttatcttgtgttgcctattaatatagtagattatattgattggttttttgaatattgatccagccttggaaccctggaatacattcctacttgatcatcctgtgtaattttttgtattgctgagttctgtttgctaatattttgttaaggatttttgtgtctgtattcgtgaggtatgatactggtcttaacttttttttttggtactgttttttctggttttggtattagtaatactgactttataatgaattggcaaatgatctgtttcccattttccagaagagattgtgcaaaattagtgtgatttttttttttttttttttgagacggagtctggctctgtcgcccaggctggagtgcaatggcgcgatcttggctcactgcaagctccgcctcctgggttgacaccattctcctgccttagcctcctgagtagctgggactacaggagcctgccaccacacccggctaatttttttatgtttttagtagagatggggtttcactgtgttagccaggatggtctcgatctcctgacctggtgatccacctgcttcggcctcccgacgtgctggggttacaggcgtgagccaccgcgcccggccactgttggtttattttgctcaacttttatcagtttcttaagatggtagcttagattgttgagtttttgagaatttgttttatggctctattttagatatatttgatgggagcttgaaaagaatatgtactctgttgagtggaatgttgtataagtgtttaattggttgatgatgtcgaattcttctatatccttgttcggtgtctactgttttatcaactattgagagacaggtgttgaaatcttcagttacaatgtggatttttctctttctcctttcagttctgtcacgttttgcagttctattgttcatgcattcacatttagtattgctatgtctttggaattgtctcttttttcattacataatcttttttcaaacttttaatctatgtatattataattgagtaagtttcttgtagatgatatagttgggtcattttttaaatctattctgcctatgtcttttaattggtgtatttagaccatttatatttaagctttatatcagttattattttaagtctgccatttttctttttgtctttttcatttctctctgagttttttcccccctaactttctgggttacatgaacagtttttagaattccatttttatttctctatagtaactcattagtctactatattatcagcattttacaatatttttttttctccagaaataaaatctcactcagtcacccaggctggagtgcagtggcacagtcttagctctctgaagcctgaaactcctggcctcaagcaatcctcctgattcagcctcccgagtagctaggactagaggcatgcaccactatgctcagctaatttctttaatgtgtggaggtggggatcttgctatgttgctcaggctggtcttaaactcctggcctcaggtgattcccctgcattggcctcccaaaggactgggattatgggcacaagccatttgagtgaaatttagaatgcttccttccctttacatcactttattcttctccatttataattgtcttaaatatttatttgtatttgagaaccatatcagtttttttgttcttcaaccatcaaacataatttagaaaacccaaaaggaaaaggagaatattatattgactcattttgcattttctgttgttcttccttactgataaattcaaatcttcttaattaattttctttctgtttcgaaaactttctttaaccattcttttagagcaggtctgctgttaacagattctcctagtttttctttatcagagcatggcctcatttcttctttatttctgaaggatgtattcactcgatataggattctggattcacagttattttctttcaacacctgacaaatgtttttgctccctctttggcctccataattccgatgagaaatttgctgtcactggaattgtttgtcccctgtaggtaagatgttctttctgtcttactgctttcaggattgttttctttgcctttagttttcagattgagcatgagtatatttagtttgaggtttgagtgcgatatgacttgatgtggatttctttgggtttgtcttgtttggggttcactgacattcttgaagaatctgtagtagattgatgttttgtcccaggtttggaaagttttcagccattactcaaattgtttttcagccctgctctcttccctcattttgggactctgattatatgaatgttagatcgtttgtttggtccctaggactgtcttttttctttttttttttttgttcagattgggtaatttctattgtactgtctttaaatttactgactcttgaccctcttctcttttgatattgagcccatcaattgagttttttatttgggttataatagtatattttagttataaaacttccagttcattctaagtatgtttgcattcattgaagcatttttatattcctgccttaaatctatgtcagatctgacatccatgttatctcagtgttggtatctattgattatctttttaaagctgatttttgtctttttaaaaagttgatttttatgattcttggtatgaagagtgatttttgattgaaacctgggtattttgggtattacgagactctggaccttatttagatcttctcttacagcaggctttctctgataccttttcagctggggaagggaggcgcattgtgttgtgccagattggggtggaagtctgggttccccactcggttgaccttgtgttggtgcttcattactgctcagtcggggtgggagttaaggctctccgtaggcctcagctgataccaccctagctgggaagggccaggatgcctaattactgccccccctagtggtctccatttacactctgggtagttggtggtggctttaccaatgaatggttatgaatgtcctaactctattaggcctcctctgataccaccctagcccgagaggaggcgggtcaccccattgctataagaggtacagggagagtcatggggtaggcacttggggtgcttagttacaacctgagcatgggttttcactggttcagatggaggtgggtccacagatttttctagggtgtttggctggagtagagcattgttgtctgaaaattttgtcctgttaggctgctactttttttggttcattggctagaaaaagcaggcttttattgttgttgttgttgttgttgtcttcactcattagcatttgtgagttgctgccttctctcttatctagtctggaatacataaggcaaaagaaaacccgggaaactcaacggttatcgtttgtgttccaaggtttctaacttgtttgccttttctctacctttccaagtcttatgtttgctttgtgtatgatactccgacttttaagtggacttacaggaaaaaacacatctgctacattgttccaccagcagaagtaaaaagctattagctttttaaaatttctgctcttagaacttagatctctggaaaggatttctgaattttaggtggtaggctgaactgaaatatattggtggtctcaaatctggctctgcatcggactcactaggagaatgttagaaaaatagatttcctagacctcaccttcagaaattctaaatctggcgcaaggccctgggaattggtagttctaaaaagctcttagatgattttgaagtgcagccatccattagctctggcaacatctttttacctcactttgctttagtttttccatccagggactccagtacttaaaaattcttcaccggtgcagttagtaagaagcacttgaagagctattttacagttcttctgctttggcctttctcttagagactctgaatcagtaggggctgagagactctgaatcagtaggggctgagatgagtcttttgagaaaactccacagactattgatccaattttgcatttagccaagagtcatcacactgggtggtttctaaggtcctttacagttaaaaacttgaataatagatgtcatatagcactaggatttaaaaagtctaaataaaaaaggtagagaagaaaaatgtgttgtctcctccctaatcttcaagtggccatactattaaattatttaaatgcctgtgaaccccacagggctgccacctgtcactatattatgtaggctgtccagtaaaactctaggggcactgttcacttacatgaggatttctgaatcctggtgctatttagtttaggccagataattcttttttttgtagggggtttcctgtgcattataagatatttagtagcatctttggcctctacccattagagcacagacacattgtcaaatgtcccttcgtgggcaaaccactgacctagacagtaatatgaatagtgcccacagttttgcaattttttctcattgtattctttaccacttactgcttaggtatgtgcatacaaatttgattttataggataggaaaagtataagtttgaagcctatttcaatcctatccccatatgagtgtcttgatgttaaacaactgctttacttgccttcgattgccctatttataaactgaattctaaggctatttatgtgagttcatcaactttcctaagatacctgttgagtacctactgtgtggcacagatactggatgaaggaataatagttaataaggtaaaggaaaccacctgtgattagaagcgaaatgggagactgcatggggaaagatgaaactagtgaagtaagcaagagccagattaatgccggattctgaaaagccatgtattctaattctgtgtgtttgtaattgacctgtgctataaaacacttaaagtctctgggtgtcagagtatctagagctgaacttggtttaacttgaaagagaaatgttgacttccaaaatgaatatttcagacaatgtgattcttttgtattatcgaattctgttgataatcagatttcttgtccttaagtatggtcattgactgtaaatataaatgaatgtacatcactgtacttgatagatggattaaccaggttctaagagctgtgaattccaaaacaatagaaaagccttgtttttactttgtaagattcagttcctcattaacatttctttttctcatttctctctctgttttagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaaggtatcaacatacttttacattttgaaatgatctgacttatgaaagaccattgtaattctagctttttctgttgtgtccatgttctttttcctttacaaatctaccctgatgttttgtattgattactttgccctttgatgtcattcatcaaatactttggtgttattcattctacttttgtggctctgcatatgatctgcagtgcttactttaaattaagttggcagttaggtatcaatggtggaaattaggtgtttatgttccataacataaacattatcataacattactaagacttaatgttttagtaattagattgtcagtctacctatgtaactgtttcctagagaaaaatcaggatagaagacagataaaatactagttacctaaaaatttaaataaatctattgttaggattttctggtaacaaattacttgggtatttatttctgtaagaaaagtttggaaggctttccacagcatttgctgtatttcttgaaggcagaagaaaaagtaagtaccatgctaacaatgtaaatttgtaaggcccttcataaatttgcacaatgccttcttacttgctcaagacacttgtgatgtattaattgctcttattcatatttacgaatcaggagtataagacccaaagaaatagccaagagcacagaggctggaactgagctttttctgaaacaagaaagctgtctgaggattcctccaatgctttagaacctggtaattttattaatttgatgtttttaaaaatatgtttatacagatgcttgcattgggcaatcaagttggcaaactttatgtttgggatttagaagtagaagatcctcataaagccaagtaagtatttagaaatttctgttcaaaatttcaggctttttctccacacttgtatgccaatgtagagaagatcatttatatttgcagtgccatccttaagtcatttttaacatttactgttttcagagttaaagttattcttttttattccaataatttttgtttttcctaagtaccttggtgacaagtcatttcttgtttttatacaaattatgtagtgcttgttgaacttaaaatatatctaaattttataaaatttgagactgagctcttagtgaagtatattctggttttaagtgcttttcgtatgacttggaacatctgcttattttctaatccgctgttttagggtagacactgacaacgttatgtgtggtctttaacctgttgtcatgttttttccctagatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttgtaaagctgtgtgtttagttactttcattgtggtgaaaaaaagttaaaagtaataaaattatgccttatctttttataatggttgttttttgtagttctcttaaccagagaaagttttgtaatacagagattaagtataggctctagaactaaagtgaattcaaatcttggctctcctactacgtgaccttggataaacaacttctcaatgcttggttccttgtgtataaaacagggataataatacttgccttggggttattgtgaggatcaaatgattcgttatgtgtgagacagttagaacagtatttgacatataataagccctaaatgtattctgtgtttataattattggagattatagttcctatggttttatattttttaatgatttcttatgtaatagtttcataagtaatatttaaaattctacagagttagaacctctgataatgtttaactgtaacctttctttatagtttaaaaaatattactgccattagatttggaactaggccattggtaaccttagaggagatatcattagggcaaaggaggagaggatatagaagtttaaatgcagtgggttggatcatgaaagagatggcaagtatgtccatgtagtgagttgttgccccttttctagaaggatgttactggctaagagggattaagtagattgagatcataaggttgggaatagttggttattttgtctccaacataaggcacactgcatttatttgtgggcaaaaattccctaaagagtgaagaccaagatcacatgtggaggggttaacttgaagcagaggagtgaagaaagcctgaatgatcataaagctaaggttggaggtgaaatgaggtgagccagagaaaaatacaaaagactgaattttgtcaggtttttaaaaagattcatgaacttgtttctataaatatgtatatttttaaagtttagttttgatatcttgtacagtgtttgatactgcccctttttgagctatctctgaagcacagtttacttctctgataatagtataatgcttaagtctgaataaacaggaaaacttactgccttttactgtcttggtccaatgaacgcttcaattgttttttagaaattttaataggaacttcaagaagtaaacctttatagcaagtaaattcttacgtacagcatcacaaaagacaaggaatactgtcatatccttttagcaaaatgagattgcctaggttcttgttgcaaaataccacataatgaaatccttcctgttgcatgattaactgggtgagaatatcatctttccttttggtccgtagaaatgtattattcactactccattcttgaggtttgttttttaatttttttggagacagtctcactctgttgcccagtctggagtgcagtggtgcggtctcagacgtctcactgcaacctctgtctcccaggctcaagtgattctcgtgcctcaccctcccaggtagcttggattacaggtgtgtgccacgatgcccagctaatttttgtatttttagtagaggcggggttttatcatgttgaccaggctagaatatcgagtgttaaagttagtgcagataatgaaagatccaggagtcagaactcacaggccagttatcagccacatgtttatactctatttttgccctctctcctttccctgaaatactaaggaagtaacatctcttttcctaatggatgttatccagaggccccagtcaccagttatctcattagcctacaaaaacacattattttcactcaagtgatctcaaggttcttagaagttatatcaggaaatggaaatcaagaagaaattatattctcaagggtcttagaagttgtatcaggaaatagaaaccaagaagaaattatatatatgtctttaattgaccattgtgtatatttatagggtacaatgtgatgcttcatacatgtatacaatgtagaatgagcaaattgggctaatatatccttcactttgttcctcatcttaaaggaaaagcctccaacttttcactaatgagtatgatgttagttattggcatgtcacacatggcctttattgtgttgaggaacattcattccttctatacctattttgttgggagttatcatgaaagggtgttgaattttgtcaaatgctttttctgcctctattgtgataatgtacagtttttgtccttcattctggtaatatggtgaatcacatttattaatgtgcatatgttcaaacatccttgcatcccagggataaatcccacatggtcatggtggatgattcttttaatgtattgctgaagatgatggtttgctattattttgttgagtgtttttgtatttacgttcatcagggatattgtttctgctagtgtccttggtctggctttggtatcaggctaatactgtcctcgtaagatgagtttggaagtattccttgctcttcatttttgggaagaatgtgaggattggtattaattctttaaatgtttaatagaaacagaaaagtgccgtcttgggcttttctttgatgagagacttggtgtattaacagttgtaatatttcctctttcatttctgatttgagtcctttttttcttattaagtgttgctataagggtttgtcaattttgtttagctttttgttttttcatttttttattttctatttcatttatttctgctctgatctttgttatttccttccactaacttgaggtttagtttgttctttttctagttccttgaggtgttgaggtttaggttgttggtttgcgatcttttttaatgcaggcatttaatgctataaacttccctcttaaaactgtttttgctgcatcccataagttttgacatgtgtttccattttcatttgtctcaaggtatctttatatatgtttctagagtcggggtcttgctatgttgttcaggcttagagttcagtggctattcgcaggtgcagttatagctgtcactgcaccctcgaactcctgggtccaagtgatccattcctgccccagcttcccaagtagctacgactgtaggcatgcatcactgtgccaggctttcaagacatctttcattttctcttgtagtttcttttttgacccaataattgtccagtatatttcttacacagtgtcttaggaaagataaaaccagctttgatatgttgagtattatgtttccgaaaagacaagacagggttgtttttcttaactttatacttgaaagtttcaaacatatagaagagtgaagagagtagtgaatactatgaaccaagtcaagcttcaacaattatcaatacatagccaatcttgatttatctatacatctacaccagattgtttcgaagcacatcccagactttattttaactgtaaaaatttactctatatttccaagaaagactttaaacaaaatatcaataccatgctcaccctttaaaaagtaatttctaaattatatatgcagtttatttagaagtataaagaaaaaagtaaaaactacctttaatttttgtacacagaaataattgcttttagtgatgggatgtattttgtgtgtgtaagtttaaagaattgtgattgtctgaatatattgtttatatgctgcattttcagattcccagtaattcttaacagattattctgcttgcatatcttttaatacatttccatgaatgtaccattatctatttaatgccttgttgttggacatgttcatttcttccagatttttgctattataggtagtattttgaataacaggccagtacacaagtctttgtgtaactctcaggctcattttataattagataggatatttctttcttattaagtttgtaccaaattacacttgccccaacacatatggtagtacccattccagttttgttgttactagtttcctgtatattatctctgcagatcagggtgttttttctgtaaagagctagatagtacatattttaggccttgccatacagtctcgtcataactattcaactctgctgctgtagggcgaaagcagccgtagacaactgggtatggctgtgtaccaataaaactttacttaccaaaacaggcagtggtggagcatagtggctcatgcttgtaatcccagcactctgagaggctaaggtggacagattgcttgaccccaggagttcaagaccagccggggcaacatagtgaaaccccacctctactacaaatacaaaaaaaaattagccaggcatgatggtgcatgcctgtattctcagctacttgggaggctgaggcaggagggaaaaaaaagaacaacaaacaacaggcagttggctagattctgtccacaagccatagtttgataaccccttcagtggatactagttattaaagcaaaacaaacaaaataagtcttaaggaggcccctaaagttgttgaagatttaagtcaaccgaatagtttataatcaaagatcaccagattgacaatgaagcaagctctatggctgagggttgaaacaataaaaaataaaaaaataaataaaaatagaccaccaaagactttagatattgcaattttcaggtaatataaaacagccaccttattttaaaattgcaactctccttcctctctgtactttctccttgttttgttactctccatttcaattatcacctactatactgcgtaatttgcttatttggtttattgtatttcttctgctactgtgatgtagtctatatgagagcagggtttttatttcactgctataaccccagcacctagagcagtgcctttcatgtaacaggggtcagaattaaacagtcataaaaataagctaacagtaagaggctatgatgactgacgaggtgaatatgagagggaaacaaatagaacttttacaaatgaaaaatacatttgttgaagtaaaaaattcaacggacgggttagattagtcacagctgaatagaaattagtgaattggaggtgatctgtagaaattaccagaatgtggcacagagaatcaagaaaatggagaatatgagaggttaagaaatatagaggataaaatgaaaagatctaacaatatatttaattggagatccagaaaaaaaaaaaaaagagaatgaagtgaaggaaatatttgaagaggtaattatcttacttgctaccaggatacttgagtgccatgtgggcatgtatgatagagctaggagaaatagcaggtggttctggcatcttccttaccatcgtgtctcccactttgactgcagtcgtgaccactgatgtgccagtctgcttcagtctctaccaagcccagaacttcaccctctatcgggtcctgaggaaaagcagcttccacggtttatttcaagctggatgaggatccaattgatgccatatccctgttgtagccttttgtggtgagacaaggcgctcatcaggacagcagattcttcaaagccttccacaccaatgtgaaggacagtaagatgtggaagttcctgggttttgtttttggacaatgggaaccaagggtggcatccctacactccatagtgtagggcctgacacgatgtaaactccctcctccagtaatcattcatcaagagtttcagtgttgtgataacctgtgagttctccacatagtggcacatcatggacctcatttccttcctggattacaactgcaccttggacagtgagggctcttttggaagtgcacacctagctgacctgccctccaactcaaaagtggacaagacctgttcagaggtgttaagcacccccacactcaatgtccattcaggccaaaagtatgctctttgccccaagggaaccaaagtcatgatgacatatgccagagcttgggtaaaggatacagtgaggattcttggatttcagaacaaagtattcctggagccccctgtacttcatgaagcctatgtccagcttgttgtcaaagaaatgtagattaattcaaaaggaacacaggattctatcggtccttttcctagtcctgaagacaaggtcagctatgtaatatccagggcccagtgcaaaatgaaaaggcaaactccttgggccgggtgcggtggttcatgcctgtagtcccagcactttgggaggctgaggtgggcggatcatctgaggtcaggagtttgagacagcctggccaacatggtgaaacctcgtctctaccaaaaatacaaaagttagctaggcatgatggcatgtgcctgtaatcccagctacttgggaggatgaagcatgagaatcacttgagcccgtgaggcagaggttgcggtgagctgagattgtgccaccacactccagcctgggcaacagagtgagactctgtctcaaaaacgaaaaaccaaaaaacagaaaaggctgggcacggtggttcatgcctgtaatcgcagcactttgggaggccaaggcaggaggactgcttgagcccaggagtttgagaccaccctaagcaacatagcaagacgctgtctctacaaaatatttgaaaattagctgggtggagtagtgtgcacctgtagtcccagctactagggaggctaaggtgggagtatcacttgagcccaggaggctgaggctgcagtgagctgtgatcacaccactgcaatccagccagggtgacagagcaagaccctgtctca

SEQ ID NO: 9 - DNA, 122510 bp, Homo sapiens
cactgtctccaagatggcggccgtgtcagtttggggcatctccgcggtccggcccggggccccgggatctcggctgtccttcctcccggtaagtagccgaggggccgttcccggccgcccccggccgcccagcccgaggccgagccgctccagggcccactccgctgcctcgcggggtcggcgggccgctgcaggccccgccgcggcctgcgccgcctcccgctgctctgcgccaggcctcgggctggggcgccgtggccgccccctcgcgcccgcccgctcgctcgctcgcttgctcgcttgttcggcgcccggctgccccggcccgcggcccgcgcgccgccgcccggccccgcgctcgcgggccccgcgcccccgatcccgccggccgggcccgccctgggggagccggcgggtgggcgggcggcgagcggcccaggccgcggagcctcgggctggcggagccggcgagcccgctctccctcggggcgcgcccacccgcccgccgcgcgcgtgccggctgtgccgggccgggccgcttctccccgcgctcgcgggcgctcgggttcgggctcgggctcgggttccggctccggctttggctccggccgggggcgcggggatccgagcggggctgaggcggcgagcggggctgacaggccggcgggtgttgtggtgcgaggcgcagcacgtgtggtgttgtgtctgccgggctgtcagcccagccgccgaggggaggccgggcgcctgtcaacctcgcggcttggcccggtgcgcgactgtcaggctcccagcaacccgcgccgccctcgagccggcccccagagcttagggtgcggagctgggccggggctatgcaccgctctgaactccttcacgtgatttcattgttaacttgtgctcggggtctgtttccatcgcgtggaaacggtgcagcgccccgtcggcgagctgccgggctgtgcagatccaagtttttaaagtttctcgctctttgaaaagagagcgcgaagacgtgtttaggggtggggaatggggacgggaaggactgtcggaagcgagttgcgctcgctctagccgctcgtgtactttccgggagttaagatccgaggctgcaggcgcttgactttccgaagacctggagactgatgacaatcccgactggaaagacaatgagtgactgtcactcattcttttacctgcgaagcttagtcaattaggacgttcgttcccagcttgttaaactcaggatgtagcttctcatttagtttagacttaatatctgtataatgagcttacttggagtaatgatactctgatttctatcctcttgagaccctcaccaaattgaagcatgattctcccagggggcttctttttaggcagctgatttaaaaacaaatcttggctcaggtttgaatgtttgcttcactcttttctttcctatcagagttaatagtaatatctctttcctagtgtgtattagttttccgtttgattttaatgtcactaccaagaatagttgctgtgggagccatttgtctagcattgtttatattgtaatgcaaatgatctccagaatgagagcagaagttctaaaaaacacttcagttaaacttatttttggaggcaaaagagttagattcagaattcagtactttagtgattaaacaagattgcatctaccagattcttttatagggatactgactttgattcagagagacagtacatttctgtttatgttttattaatgttcgtttcaggacagcaatcttgaatttatatctttattatttgggcttctctttagtcctacaagtagccagtgtatttctttttctgtaccgtccgtttgatatgtagtatgtgcgttgaccccagtgattctgggccttcctcatttctagttttcctgtctgaattacttacacgcagtttgacagttgtgactctcttcagcatatgaatagaaacatcttagtttgggttaggagaagctatcagcatgtaattcttaaaatttgaatgaaagtggattattgttaaattcagtaagcacttttactctaggctattttcaatagtatttttgtttccattaggagagattaaggtaatactgtacttaaattataaactgggtgtgcatattgtattcattcttttcatgtaagaactaaaattttctcagtcgttttctgccttattgactgtttttgtctactctgaatgtctagaattttgaaagatgaaagattcacttttactttcattgcaggattctttctactaatccagatacttgttgaagtgctgactagtttcttggggaaagatgtcaaggaagagttgaaattcctagactggtgagcagagattgcggagtacagaatagccatcacccactctggttagtggtagcttaaaggtcattcttagaacatgtcatcgtgtttcctcattgtatcctaattactcatcttttttttttcttttctttttttttcttttttatcccaatggtttacatacatgattgttttggaatattaatagataagtttggaaattcttaagggtgcctagtaaacacttgctgtttgattgctttatgatgaggatgcttattttcattcgaaataggtcttggtagaaaactgaccttattttcattgcttttcaggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataaggtaagaatggcatatgcttcggggtttatagagctgatgatataggatgctacaaattcacatttctgggaagttatattcaagttttttgtttggggacttctgtggagtgatcacctctggttttttattggtgagttgtagctatgagagcttcatagatttgttctggtactttgaaatatttgaagcctaagattaaaaatgtagaatgttaatctgactaaaagaacttatttacattacaatgaaaaagtgacatatgagtttaaaacttttttttaaatttttttttattattttgcttgaggagtactccagcgtgagactttaaaactttaactaaaggttcttagaacaccttactactggaagttgatgagcagccaaatcatggagacttgaatttgaaacaagcagatgactctgagaacatttttctgttttccattttgttgcagattactcgttagacagaaatgagacagattctcatgacccataggcgcaactaagcaaacttagcaattcttgtttctgctgtttgtattatagctttctgtcatgtattatggctttgcatatgatgaagtcctaaatgctatttatgacagctgtagttgcatgggacaggaatacagtatcctaaactagaaaagttctggagggtctggaacagtagttcatgcctgtaatcccagcgctttgggaggctgggacaggaggatgtcttgagcctaggagtttgagcccagcctgagcaatatagcgagaccccacgtccaccaaaaatagaaaaattagccaggtatgggcgcgcctgtagtcctagctacttgggaggctgtgtcggggaggattgcttgagtacaggtgtctgaggctccagtgagctatgctgtcaccactgcactccagcctggacaactgagaccctgttctaaaaacaaaaagaaaggtaaagttctggagagttgggagttttgatgcccagatgtgtactttactctgttgtgttttaggatgttattgtatatagttgaaattatgacttcttaaacagtaaattttggtgcttaaatagatatttggagattaggagaattttgttagtacctgttttttacattgacctagtatcttagctgtaaatttacttaaggtgctctgaattatagttccttggagagcagtgatgctttaagttgctgcacaccttggtagacataagtaaaatgatcttcattttgcttaagatgatggaggatactcctagggtggaaagatggtaaagttaacattgaatgtattttgaaaattggagatttgatctcaatttgttgtattattagcagcccactgaatacctgtagatttttctttaacaattgaaaattaacggtatttttctttgatgaaatttttagagatctatttcagggttcaattttccctgtgaacattgaaataaaacataatcttactgttattacccttgaaatgattctcatacagtcatgaattgatagagaatctcattcataaaatggctctatgtaatttgagcatttattaaaagtatatattaaaaattcagggtagacaagtaattaaaatgctttattctatatttaagtgctgtaagaactcttacctgtagaaactttatcacatgtggctgaatttaaatacagttatcggatttctacaattattaaatgatctaacaggttaactgcctggaaacaggaaataatttatagttagatcagttcagtgccatacctgtgaattggatgttataagttcctgttaggccacctgtttgcttttatttatttatttttgagacagaatctcgttctgtcacccaggctggagtgcagtggtgcagtctcactgcaacctccgcctcccaggttcaagcgattctcttgcctcagcctcccaagtagctgggattacagacatgcaccaccacgcccggctaatttttgtatttttagtagagacggggtttcaccttgttggccaggctggtctcgaactcctgacctcgagtgatccacccgcctctgcctcccaaagtgttgggattacaggcttgagccaccgtgcctggcctgttgtttgcttttattgtaattacacttgcttgaattatcaatagataattttaaaaaatattagctatataaaaatgtcatttgagcatatttttaaaaggtagtaaatatagtacagtgcaagacaaatccaagtcctagaaccctgagattttacttttggaagggaccctgagaaccgtctaatccaagtccttattttgcagctgagctaaggacctttgttgagaccatttcatagcacctttgcattaagaaaagtttaattcagtagagatgtgctgttttgctttgactggagtgcagtggtgtgatctcagctcactgcaaccttcgcctcccgggttcaagcgattcttctgcctcaacctcctgagtagctgggattataggtttgcgccaccacgtgtggctacttttttttttttttttttgtatttttagtagagacagggtttcaccatgttggctaggctggtctcaactcctgacctcaagcgacctgcccacctcggtctctcaaagtgccaagattataggaatgatccaccgcacctggccacatttgattttggagaaataaagcaagaaaaacaaaagtgatttaataattgaaaaaatgaaaaagaaatgcccatttgcttacatagctttcatatatagtgtttttttgttttttttttttttttgagatggaatttcgctcttgttgcccaggctggagtgcagtggcacgatcttggcttactgcagcctccgctgcccaggttcaagcaattcttccttctcagcctcccatgtagctgggattacaggcatgctgaccaccatgcctggctaattttgtatttttagtagagacggggtttctccctgttggtcaggctcatctcgaactcccaacctcaggtgatccgcccaccttggcctcccaaagtgctggcattacaggcatgagccaccctgcctatagtgttaactgaagtaactaaatttagacatgttggaaaatagagtttgtttcttcaggtagacttgtatatgtactaatctcattggaaaactaatttcatgatagtatctattcaattagagttggtgagctctgttctatatttttaaatggagtcttattttcagtagtgaatttcctgtgtgacttcccccaaagatatgaaaagtttacattaaaaatcgtaatacagtgaactctaggatgagagattattcctttgaacagattatgtctgctccttttattgtattttaactattttctttcctctccttcgaactacgcagtcagttgctatgcagaattgatagtttgctgttacgaacctagatgttctcaaaaaaagaaaagaattatccagagtttatttgacagtgatggagaaaggaaggtgtataggtcaggagtagtttcacttttaggaattaattggttcagcatatagtcattgagcacctactgtgggccaggcactctgcttggaacagaaacagttctgtcttctctgggatgctaatgcaggtatttctattgacctggccaactgtaaggtgaagatgaaattcaaagactgcgtggagtaacccgagcaagttcctctttactttttctggtatcaattctaactttttgtttttttttggtgatattaacctttggaaggaactgtatgttagattttcggcagctgagtggttttgatccttttgggagatcaactgtgttggaatacgtttaagaggagtttttgtgaagacattggaactttagtgtgttcttttcacattgataagtactgaggagaatccatgggatactgtgattaaaagtttttaggccaggcctggtggctcaggcctgtaatcccagcactttgggatgccgaggggggggtggatcacctgaggtcaggagttcaggaccagcctggccaatatggtgaaaccccatctctacagaatacaaaaatcagcccggcatgatggtgggtgcctgtaatcccagctactcggtaggctgaggcaggataatcgcttgaacccaggaggcggaggttgtagcgagcctagattgtgccactgcactccagcctgggcaacagagcaagactccatctcaaaaaaaaaaaaaaaaaaaagtttttacccatgttataagggaaatttttgagctaactttagagtgtggtagttaatggtgagtttatttattaaagtgtttatttactatgtgccaggcgttattttaatgctgtatatatattaactcatttaatcctctaacataactagctactgttaggttagttagttattaataacataacagtaccagcagtgaaatagctactgttattttacaggtgaagaaactgaggcataaaagagatttcagtaacttgctgaagtcacacaaatattaggtggcagagctgggatttgaatttgggcagtctggctccagagtctttgtaatagccatactgaccacctcttaggagcagtaatgtatgatggctatcactgcactcaagtacagaatcgtgaatgtccttggtgttaacttcatagcacatttcctaattgttaaaggacaaattcccgcccgtcttcattgtgtccatttttctttttttgcagaacagatttgaaaattcactttggaccagtgataagaatgtgttaggaaccaaagattaggagtaatctagttttgtatatctgaggtccattaaaaaaaagtttcacctacatgccatttttttcccttaaagataatttctgtgctaactaattttcatttcagttgtcactaacattttctgataggcaaggtagggatcagttgtattgctataccagagtgctttaatttgggacagaaatactgttttccttgaatcatgggattataggtgaggagaagagtgtgtaactggcttaaatagcatcttcctctttgtaaatttctttttgaaatatagatattactgtaaggtaatttgttccatttacttcagttattcattatttatttagcaaacatttgaatgcctgccatgaacagtggatttaagatttaggtcctgtgaggggattaaagcagacagaatagagatacaaaataaattttttgaaagccttttttagtttatgaactgtaatttttttacattattattttttcataacaattaagtatcatgactcagaaataataatatgtttagtgggcaaggcaattatttgagactgtgatggtccatttaaaaaattatctttatatagtgagtcttggaaagattcaatttcctttcaagaatagttttcaccttgatttcaaacttctgagttcatttttacacactgacataatttacttgaatatatatagtttgtgttctgtattactagcccagaaaaatattctctttcatggtaatcagccagatcattaaaagtattgttatttggtggcatagtattttggaacagaattataatttgctaaagcgttcagttggacagggaagagtaggtattgtcaactaatgttattgttcaggttactcccagctgggtaacctggagcagaaagatccaatgataaatctcttgccttctactctaagttacatctcaatttggtcaactcttagtagagtccaaattattttgttttattggaatttatattttaaattatagaggaagtagagctttgacaggaatttagaatttaaattttcgatgtagagatactgattaaaatggggattttttttttttttttgagagatggagtcttgctttgttgcccaggctggagtgcagtggtgcaacctccacctcctgggttcaagcgattctcctgcctcagcctcccgagtaagctgggattataggcgcatgccaccatgcccggctaatttttatatttttagtagagatggggtttcaccaggttggccaggctggtctcgaactcctgacctcatgatccgcctgcctcggcctcccagagtgctgggattataggcgtgagccaccgtgcccggccagggatatgtttttaagttactgaaagttaagagtgatgaagttttgatttagctatttggaaatgacctttatagtagaatagttgcacattttatatgttagaatggtggtattttataagaaaattgttaaccaatataagcttggaaatttcaatttcaattactctgttgcgttgatactgtataaaaaggcaataaatagttgtccatgctattaaattcagggctatgtggactgcttgacagaatgattgttcactttggaaaaacaaaaaaaacaaaaaatcttctgaaggcaaaagataaaatattgaggatacagtgacgtggaaaatgtagctattatcaagtgtgaaatggattgatctcagtaattgttatatttaataatttaaacattttttatgacatgcatttcttttcttttttttttttgagatggagtcttgctctgttgcttaggctggagtgcggtggcccagtttcagctcactgcaacctccgccttccaggttgaagcaattctactgcctctcccctcctgctgtctgcgattacaggcgtgtgccaccatacctacctaatttttgtatttttaatagaaatggggtttcaccatgttggccagttgtgttctcgaactcctgacctcaggtgatccgcccacctccgcctcccaaagtgctaggattacaggcgtcagccaccatgcccggcccatgccgtacatttctgacatcattgtttataccatttgtttgtgactccaaatgtaccaggagcagtggcctagaaataaaaatttgttactaacaagtcattgaggtggattaattgtaaatctggttaggaattaattttgtcttagcagatttattcttcaaaaattcagaaatttaaaaataactcagagatatgtttgtaaaatagtatctgtttaagtacaatcagctgcacagtttttttttttttttttttttgagacggaatctcactcttgcccagactggagtgcagtggcgcaaccttggctcactgcaacctctgcctcccaggttcaagtgattctcctgcctcagtctcccaaatagctgggattacaggcatgcgccaccatgcctggctaatttttgtatttttagtaaagatggggcttcactgtgttggccagacgaatctcaaactcctgattggcttcccaaagtgctgggattataggtgtgagccactgtacctggccaactgtgcagatttttttgatcttctggttcacctatgagcacaatgatttttggtaattttcagtgcatgacatacctcgaaataaagctactgagctactaaagcttgggttagccattactaatccaaagttctataccaaaccaatttttcttttctttctttctttctttttttttttttttttttttttttgagacagagtcttgctcttgtcacttaggctggagtgcaatggtgcgatctcggctcactgcagcctccgcctcctgggttcaggcgattctcctgcctcagcctcccgagtagctgggtttacatgcacccgccaccacgcctggctaattttttgtatttttagtagagacagggttttgccacgttggccaggctggtctcgaactcctgacctcaggtgatccacccgccttggcctcccaaagtgctgggattacaggtgtgagccaccatgcccagccaccaatttttcttatgcttacaacctagacatttttctagcgaataagtactttactctttcttggtctaccttccaattggtgaaataaagggaaggaattaatgaagacatcgggtaccacaaatggcttcaggaatagaaatccagaggttctaatggtcttaacctcgttttttctttgctctgtatcaataggctaagggaacgtaaagagttgcttatagaaacctattaatagctaacatttgttaagggctgatgatgtgttagggacttttttttttaagtgttttaacatgtactttcttattgaagtctcaaaagaattctatatgattaaattttataggcataatatatttatataataggtatttaatagtatttaatcatacaaattttcggcagggcgcggtggctcacgcctataatcccagcactttgggaagccgaggcaggcggatctcgaggtcaggagatcgagaccatcctggctaacgtggtgaaagcccgtctccactaaaaaatacaaaagaaaaaaaaaaaatattagccaggcattgtggtgggcgcctgtagtcccagctacttgggaggctaaggcaggagaatggcgtgaacccgggaggtggagcttgcagtgagccgagattgcgctactgcactccagcctgggtgacagagtgagactccgtctcaaaaaaaaacaaaaattaataataataatacaagttttcattatgtcttatagaaaaccaaatggaaaatgaatataaggaaatgcaaaatacattaaatttctttttacccttgctgcctgttttttctttagttcatcctggacttgtgggccaatacttttttgttatgtttaatactaggagagcaaatacataacaggaactgtgatgaatctggaaagaaaatttatatcattcagtcttcctgaagctgtaagaatctccttaacatctattagatttattttctctttgcatttaaagttttggagaaaatatctttgtcatactgacttggttcttagctatgtaagaggactaaatctaggtgcggagtttgctggtttaaatagaattaaaaatttatttttttctggtgacctggagagtgtttcttaaaattataataatgaatacttttcatgctctgatttatgtataggaattattaagagcttcactctgataaagttatttaccacttggctactcaggggtggagtcatttcacaaaggatctgcagcgaatgaattagaccaggagtaacttcacccttctgcttgtcccagctggagcaggattaggactcattcagctgcagctggttcccaggaaaatgaaagcagttccttctggttttttcctttcatatgaaagtcatagttcccagcagatggctttcatcagccctgtacatgtatctgtaaattcaaggccaaggaattattttcaacttcattagggaacaggtgaagaaaccatttgtagtgtggcactattttattaggagttgaaattaagcatagagattatagtagtatgccattctgggtcaaaatagtttttaactgtcagcaatttaaagaaaaaaaaagactgctaaggaaaagtaagtctggctgtagtgttgattgaggtatcttttatggttgaattgtattatgcttacgaaacatagattattagaaaaaaagacttgtatcttctgcattgtgtagaatgttcagccagtagcaatcttggatcacagtgattctaatctgatttcacaaataatagggaaatttgagagccaaagaggttgaagtgtcttgtccagtgccacacagccagttaataccatctggaagaattggtcaggcccttctcaattttgtgcttttttcattatgctgtagtactgctttatagtattagagagcagtgagcctaaaataatttagttagaattctcttccttaatggaaaccatagaataaaccttgtctagagaatattggtggtatcgtaaaccacaaatatataaatctgctatttcagtgtgtgaaaatagctatacactcttgttagagttttgaaacaactttttgggaaaagactgctttcttatggcccaagttagaggaatcaaggttttcttatgttgttggctaaatattagaaggggaacatgttgagctaccttaatgctggaagaaaaagtactccttgagttttgggaaaaaaagtccatttaaaggtaagtctaattttcagtaggtctgcaacacaaatgacctctgagtgacttggatcattggttagaatttaaaattcttgagactgagctagagatagcaaggtacaaacctttctattaattaatgaagtaatttttaccaaagacattaaatatgggtggaccaaaagtgtatagtctagcacttctataaacatagtgtctgggaggagcttgagagatttgtaatgttacttgtaaacagaccgtgtggggaagaccgcagacagcacatcattttttgtctttattggtctttatgactaacacttcatctctgcatcacttctgctttgctgtaaaacttagcaagtacattaggatagtggcaaataaagattaagattgaggacagatgtttgtaaaataactgggcgattttaagattataggtgtaacttgttaagaagaagataactggtgtggaaataaaatctggcagccaaaaaaaaaaaaaaagctttcaatgtgttaaagaagatagttgcttcttttgccgtttaccttttatgtagaataggtgattccgcagatctagaggtgttgtcagacttgtactatgggctgcgttttcctccagggaattgtgaactgtagttgacctgaagagctgctaagtgttggtttttaattctttgagcttagtaaagtctaggttccttttttcttagtcattgggtacagtgaagcatttaactcctgagttttctagaacctttaacagaactctcagaaacattattactatttttgtgtgtggagtgtgattctgtactttaatagtttcccaatttttctattcagggcatctttaaatatctaacttactatttaaaccctctttcaccattttcctgccttacttttttccatgccactcagtttttctttaattctgtaacataaatccaaagccttattctttggaaagcagtggtacttggcactaaattcactttagcattacctgaggaagcttaaaaaataaataccaaactaattaaatttgactagtagtgaggcccaggtttcagttttttttattttttatttttttaagaatgtttatctgatgtgcagctggggttgagaaccattgctctaatgcttagaaccaacatctctgtagtggggactggctaagagagtcagaagacagaagaagcaggtactttttaacctcataattgacattcaaacaaatgatgaaatagcatgcttcacacacaccctcatgaacacactttggacccaggacagtgtacttctggaaatgtacattctgttttattgtcctccctggctataactactctaatcttccacctttctttctccttaccctcactgctttatctcaagaagatcttgtgtggtatatagttgcgagaaagttacctgcatgattccgacaggtgccctgccatcactctaatgctgttctcattgcttggccttatggcacattctcactcactcactactcctgcatcatgttggcaaactccagccatttaccaccttctccttttttttttgagttggagtcttgctctgtcacccaggctggagtgcagtggtgcgatctctgctcactgcaacctccatctcctgggttcaagcgattcttctgcctcagcctcccaagcagctgggattacaggtgcctgctaccacccctggctaatttttgtatttttttagtggagacggggtttcatcatgttggctaggctggtcttgaactcctgacctcaggtgatctgcccaccttggcctcccaaagtgctgggattacaggcatgagccatcgtgcccaacctctctgctttaactttggggaaaatctcatgaccatgtggtgggatgccacttacaaatttgtggcctccaatctgagctctgccctctgcttgaagatgtatgtctgtgtatagtctgttctgtctgcagaaattcagtatttcttcccacctttttttctcattttcagtagatactcccatatgctacatcatagagataatggaatctgtccaattgagctcattgagtttatacccctctcatgccatcctaaatacatctgtgcttatttctgcccgctttgctaccttgtcataggacagtgaaagaagtgtgaaaggctcatctctccattctttttcaggaccccattctctgctacctcaggggccgtgtgccatcaaaaatagtcccattttttgactctatcatctttctcgctcactttttagtccttagcaggcagaagactctcccgttagagtaaaaacaaccaaaaaaccactgcagatccttctttctatgtataccctgtctgtttccattcatttttaaacttcttgaaaaaagtctatattcattccacgtctgctgcaatctggcttttggccctagagcagcactatttgaaactgctcttgtggacagttttcagtcttattttacctgagttctcagctgcatttagcatttgttgaccattcttccctttcctctgggataattcttagatgtctcccccttcctcccatctttctggtaattccttttcagtttattggcgttttatcttttgcctgtatctagatgttggattccctaaggttctgttcttcactcatttcttactgttttctagagagttatctagagataactttcctgagttatttctagacctctgtgttctttactgatgactctaatttcatatcttaatttgagagctctcttctgatctctggacttgtatattccattgtgtagtattttatgtcagtctcttcagattcacaatggctcagatggaatttatcaacttcctttaaccggctgtcatttcttacagtggtaagagccattgccatcgattctgatgcttaaaatggaaactttggtgtcatcttccatacctcacttgtctgtcttttggattcagttctattccatcccatgtcttctctcttacactttttaacatctcttatttaacctcttctgtattcgaggtcctctgttagagcaggtcctcatcatttctctcctgattaccttagtagtttcttcattgattttccttcctccagtatcatcttcgtctagtccacattattgccaaaatgatcttactaagaaatgattaagaacacaagcgcaaagaccagaccatctgggctttctatcccacactgggactacttgctttatgaccttgggtaatttgcttaaccattctttgccacattttcttctataaaatggggataatacagtgcttatctcatagtgaagttgtgagaatttaatgagttaatatacatctgggctgacagaactttgtgcaatgatggaaatgttctatatctgtactgccctctgtgatagccagagccatgtgtagctattgagctcttgcaatatggccagttgagtgaggagctgaattttaaattttatttagttataatttaattgaaatagccacatgtggctagtagctgctataatggacagtacagaatatgtaaagtccttagaaatagtgtttagcacataagtgctccataaatgttaactgttattaccatctttctaaaattaaacttctctgcttaaaatccttcagtaccaaattctgcgatatagtatatatgagttgtaacccattcccgtgcgttgctccaaacttgtcaattgccacttcttcataatgccctctgtgttccactgtaccagttctcaaagtgtggatgtagaggacagcaccagcaatagtatcccccaaaaacttgtttaaaatgcagattcttgagccatatttcaggcctattcaatcagaaactgaatttggggctttgcaacccgtatgttagtaagtcctccaggcgattctgatgcacgcttgagttcgagagccattgtactgcatcagtctccctgcagttcctcagatctatcttgttttcccttgcccctatatttttctcctgtctggaatgattgttatccattttttcttcctcataaattagctcttcaaccttgcagacttagtttagtcaagtttctttctgtttcttcctccttatcacccaccctgctcccaggctgacttcaagacctgtcttaatctccatgctgcatatgtccgtacacacttgcatcatagaccattttacatagtacttttttagcctgtctcctattagtgaatttaggttcttgtttttcgtctttgtatttccatctatctggcagtatctgattgttttgtttatttttaatttttttaattaaaaaatttttaactgttttgtttgggttgtttcatatgtattaagcatcttccaggggccggcacagtgattaggagtgacagagtaggtaaagcagacatcgtctctgtaataaatacacatggtgataagtgctctgatgaagtaaaatagagcactgtggaaacacagaggagggggtggaaaaagtcagggaagtctgttcagaggaagtcacatgtgaagttagtgaagtggggaagcaaatgggtgcggtgggaaagagagtagttcctgaaaagggaacagcatgtacaaaggcctagaagcaaaacattgtatgcacatagtaactgtttaattggatatgaattttaaaaatcacatgtctaacttagctctcggtttcgaagacatcacccttcccagcaaacattgcattttatatgcttctgtatttttaaagcagttttcatacttgatatcacactttgagtagatggttatggtgtgatagggtaacttccaagccagcaggatacatctttttacttactgccttttaaagcagaaaaaaggatttgttttgtctgaaaattattccacagggccaggaacacatcagtggtgacagaggtaaacacattactcttattgagtaagaatagccaaggtttggccaggcacagtggctcacgcctgtaatcccagcactttgggaggccgagacaggcagatcatgaggtcaggagttcgagaccaccctggccaacatggtgaacgtctctactaaaaatacaaaaattagccgagtgtggtggtaggtgcctgtaatcccagctacttggaggctgaggcagaagaatcacttgaacctgggaggcagagtttgccgtgagctgagatgaccaccactgcactccagcctgggcaacagagcaagactccatctcaaaaaaaaaaaaaaaaaaaaaaaaagccaaggttttaaataagcattagaccattgagaaagcatatcattaggaaggctgaaggcagccagtgtgccagccacaactgttgtcacttttttagcctcactgtgtattggctctttttgctcttgttgatgccatcccacttcctgttctcattagccctccattgtaagagtaacgtggcattcgttaatgtgctgtgtaagctccaactattaatttgctactgaatatttgcttttgtctttttgagactttatataatttttagtaaaataaaaactcaccttttgctctctttgattgctttgcaaatgggttgtcttcataatttattaactttgaaagaagactgataaaaatacagttttgtttctcataactttagccaatcgggacaaacctagagaagaaggaaaaagggaaataaaatctgttcccctaaaactttatatggatggtaatattgaaatatttcagatattgaagaattttgctttcacatacatatattttttgatataacaattttgtacataggtacaaaagataggcagtccaggtgctatgattgccaagttttacttagtcagaattatatagttaaggtaataaatggaactagagcctaggtctgttcaatcttagtactccttgagccacatcaagctgcctgttgtgcaagactacagttcatgaaaatgacaagcattaaaaaacaagtactcctggctaacacggcaaaaccctgtctctactaaaaatacagaaaattagccaggcatggtggcaggcgcctgtagtcccagctactcgggaggctgaggcaggagaacggcgtgaacccgggaggtgaagcttgcagtgagctgagatcgggccactgcattctagcctgggcgatagagtgagactccgtctcaaaaaaaaaaaaagtacgaccaggcatggtggctcacgcctgtaatcctaggactttgggaggctgaggtgggtggatcacctgaggtcaggagttcaagaccagcctggccaacatgacaaaaccctatctctactaaaaatacaaaaattagccagttgtgatgatgggtgtctgtaatcccagctacttgggaggctgaggcagggagaattgcttgaacccgggaggtggaggttgcggtgagccaagatcacaccactgcacttcagcctgggcgacagagctagactccgtctccaaaaaaaaaaaaaaaaaaaaaaaaaaaaagtgaatgctccttcaatatttatttcatagatctgtgaaaccatttatcaaatcataggtattattcatctttggatccagcttgcagcactttctaacgatgcccatagagtgtttttataattgaaaccatcatgtttgaactagaagggggatgatagaaattaggttgattaaaaaaattattcagctctctttatcctctcaaaatttatagcctctagatgaaaaggagaaaatagggtatcagatgtattctagaaatgcttgatacctcagctgaaaagtaccatttgccacttccttcaagatagtatttgttttgtattacccatataatatttttaaaagttaaaaacacttttctgaataggtaatgtattcatcactgtgtaaaattcaaaaagtacaaaaacgagaattctgtgaaaagtattattctaagtcttattccctagctacttggctcccctctgggaggcagccggtgagctgtatgtttcttttgtaccttttgaaatgattgtatgtgtatacaaatgatcactttatgtatacatttctcctgtccccccccccttttttttttttgcatttggcagcataccttaacatactcttttgcatcttactttttttttctcaccacttaacaatatatgctcatgcacttcataacaatgttgcagtcaacagtagaccacatatacaaaagttgtcccataagattttaacggagaggcggagcacagtggttaacccctgtaattccagcactttgtgagactgaggcaagcagatcacttgaggtcaggagttcaagtccagcctgaccaacatggtgaaaccctgtctctactaaaaatacaacaacaacaacaaaaaatttgtcaggtgtggtggcaggcttctgtaatcccagctccttgagaagctgaggcacgagtatcactggaacctgggaggcagagtttgcggtgaaccaagatcccgccactgcactccagcctgggtgacagaacaaaactgtgtctcaaaaaaaaaataataataaaataaaataaaattttaatggagagaggtgaaattaaggaggcttaaagatgggtgactagaggaccccaacattcaccttctccacaaaggtggaccaaaacagccagtagataatcacattttgaatgcagcatttaagagagaacactgaaattaaacacggaaaggatgaggaacctctgaggcacaggaagagagggaagtgaacagctggcctggctgggattggcttggagccgggagaaagtccccagtgtggagaacaggtaagagacagatccccagtgatctgtgttcccaccatggactcctgtaatctggcctcaggagagcttcttggccttcatgggccctgatactagaataggaaaatagggagctgcctggagcccccttgtccgagacccaatgagctgcagcagggtgccattttgacagtccagcccctattagaccacatctttctctggcgcccaattgcccttgaatctccatatccgtagtgctctgatgacatgttcctgtgtccatccagagggctgcagcatcacaatgccagctggacccagcagtgcagagcatattaattctccagaaagagtccagtggaaaaaaagaaaaatgcctgagaaacagttcaaaataatattaaagaagctcagtgaaatacaagggtacacaatgtaaagaaatcagaaaaataattcatgatctgaatgagaaatttaacagataacataaacaagaaacagaaattgtagaactgaagaattcaactaatgaaataaaagctataattgaggtggtcatggtggctcatgcctgtaatcaatcccagcattttgggagaccaaggcgggaggatcgcttgaacccaggagtttgagatcagcctgggcaacatggtgagacccctgtctcttgaactgtgatcatgccactgcactccagtctgggcaacagagtgagaacctgtttcaaaaaaaaaaaaacaaaaaaaaactacaactgtgagtgcttttaactatagactagatcaagcagaagaaaggacatctgaatttgaagacagatcttttgaaataattgtcatacaaaaaaataagaaagcatatgtgacatatgggagggacaccataatgtgaccaaatatttgagtgttgggtattccagaagaatagaggggcaaaggcatagaattattactgaaataataactgaaaagttttcgaatcttacaaaagatacagacatacagatttagaaaactaaaagatttcaaaatagattcagtccataaggtgttctccatggcacattatagtcaaactgtcacaaagacagagaattctaaaaatagcaggaggaaagcagtgaatcacaatataagggaagccccatcagactaacagcagaaatcttataggccaggagagaatgggatgatatattcaaaatactggaagaatgaaactactggccaagaatactacacctaacaaagctgtctttttagaatgaaagataaataaattctttcccagataagaaaaaaatcaagggaatttatcaacactagatggccctacaagaaatgcttaagggagttctaaatctgaaagtgaaagggcaatatgtaccgccatgaaaacatgcaaatacataaaactcactagaagagcagacatacaaatgaaaaagagaaaggacccaaatattaccacaggaaattaccaaactgcagtgacaaccaatgagagaggaagaaaggaacaaggatacacaaaacaaccagaaggttaacaaaatacaggataagtcttcagctgtcaataataatcttgaatcagattaaattccacacttaaaatatgtagataaactgattttttttaagacccaattatatactgcctacaagaaacttacttcacctatgaagacatatagaccgaaagtgaagggatggaacaagatattttatgcaaatggaaaccaaaagtgattaggagtactatacttctattagataaagtggacattaagtcgaaaactgcaaaaagagataacatgggtcattacatagtgataaagggatcagtacagcaagaggatataacaatggtaaatatatacgcacccaatataggagcacccagatacataaagcaaatgttattagatctaaagggagagaacaactccaatatggtaatagttggggacttcaacacttcacgctcagaattgggcaggtcagctgtgcagaaaatcagcaaaaactgtggatttaaaccacactttacaccaaatggacctgactggtatttacagaacattttatccagcagccagagaatacacattcttctcatcagcacatggatcattctctaggatagaccaaacaagtctcaacaaattttttaaaaccaaaatcatatcatgtattttcttagaccaaaatggaataaaactagatatccagaagaagaggaactttggaaactatataaatacaaggaaattaaacagcatgctcccgaacaatcactgggtcaatgaagatactaagaatgaaataaaaaaaatttcttacaacaaatgggatatagcaaaagcagagttaagagggaagtttacagccaataagtgcctccattaaaaaagtagaaagatatcacataaactacctaatgctgcacctcagggaactagaaaagttaagaacaaactaaatcctcaaattagtagaaagaaagaaataataaaggcaggagcagaaataaaatagaaactgaaaaaatacaaagaatcaacaaaatgaaaagttttttaaaaagacaaaattgataaactgctagcgaggcaaaccaagaaaaaagagagaagacccaaataaattagaaatgaaaaaggagacattacaactgataccacagaagtacaaaggatcgtcagcaactattatgaacaactgtatgctaacaaattggaaaaccagaggaaatggatacattactggacacgtacaacctaccaaaattgaatcaggaagaaacaatacctgaacacccaataatgagtaacacaattgaatcagaaataaaaagtttccaaaaagagaaaagcctaggaccagatggctttcctctcaattctacctgctgaattttaccaaacttaagaagaagaactaacaccagtttttctcaaactattccaaaaaattaaagaggagggaattcttcctaactcactctacaaggccagcattatcccaataccaaatccagataagaatacaacaacaacaacaaaagaaaactacaggccaatagtcctgatgaacatacatgcaaaaatcctcaacaaaatactgatagacaatccaaacaatccagcaacaatcaaaaagataacacaccatgattaattggggtttatcctagggatgcatattcaaatatgttcatgttcaacctatgcaaatcaataaatgtgatacattgcatcaatagagtggacaaatatcttgataatttcaatagatgcagaaaaagcatttgataaaattcaacatcttttcatgataaaacctctcaacaaattaggcataaaaggagcatacttcaacattaataagggccatccatgacaaacccacagctaacgttatactaagtggggaaaagctgaaagccttttctctaagaattggaataaggcaaggttacccactctcacaactcgtattcagcgtagtactggaaatcccaaccggagcattcaggcaagagaaagaaaaaaaaggcatccagattggaaaagaggaagtcagattgtccctctttgcagacaacatgatctcatatgtagaaaaacatgaaggctctacaaaaaaacttttagaactgataacacaaattcaataaagttgcaggatacaaaatcaacatacaaaaatcagtagtgtttccatacaccaataacaaaagaatggaaaaataaagcaatcccacttacaaagctaccaagacaatcacacaaaacctagttataaatttaaccaaggaggtggaagacctctataagggaaactgtaacagtgattaaaaaaaaattggaggacacaaacaaatgggaagacatcccctgttcatggattggaagaattactgttgttgaaatgaccatattacccaaagcaatctacagattaaatgtaatccccataaaaataccatcaacattgttcacagaaatagaaaaaacaatcctaaaatttttacggaaccacaaaagaccctgagtagccaaagcaatcctgatcaaaaagaacaaagctgggggcatcacactacttgacttgaaaatatattacaaagctgtagtaaccaattcagcaaggtattggtataaaaacagacagaccactgggacagaatagagaactcagaaataaatccatgtatttacagccaactgtttcagtaaaggtgccaagagcatacactggtgaaaggacaatctctttaataaatgatgctgggaaagctggatgtccataagcagaagaatgaaactagacccctatttctcactttatgcaaaagtcagctcagaatggattaaagacttaaatgtaaggtctgaaactgtaaaactacttgaagaaaacataagacaagaagctacaagaaaacaagaaagcttaaggacattgatacaggcaaagattttatggttaagacctcgaaagcatggataacaaaaacaaacaatagacaaatgggaatatattaaactaaggagctactgcccaacaaagaaaacaatcagcagaatgaagagacaacctgtagattgggagaaaatatttgcaaactattcatccaacaagggactaatatctagaatgtacaaggaactcaactcaaagacaagaaaaccaaataatcctattaacaagttggcaaaggatctgaatagacatttctcaaaagaatacatacaaatggccaacaggtgtataaaaaaatgcccagccaaaagtgcagtggctcacacctgtaatcccagcactttgggaggctgaggagggcggatcacctgaggtgtaggagttcgagaccagcctacccaacatggcgaaaccccgtctctactaaaaatacaaaaaattagccaggcatggtggtgggcacctgtaatcccagctactcggaaggctgaggctggagaatcacttgaacctgggaggtggaggttgcagtgagccgagatcatgccactgcactccagcctgggcaacaagagggaaactccatctcaaaaacaaaacaaaacaaaaaaaaacctcagcatcactaatcatctgggaaatacaaatcaaaactataataagataccattctaccttgttagaatggctgttgtcaaaaagacaaaaaataagtgctggtgaggatagggagaaaagggaactcttatacatcgttgtgagaatgtaaattagtacagccattatggagaacagtatggagatttctcaaaaactgaaagtagaattgccatatgatccagcagttccactattaggtgtttatctaaaggaaggagaatcagcatatcaaagggatacttatacccccatatttattgcaacaccattcacaatagccaagatatggaatcaacctaagtatctatgagttgttaaatggataaagaaaattttataaatgtatatgtatatatacacaccatggaatactactcagctatcaaaaaagaatgaaactctatcatttgcagcaacacggatggaactgaaagccattattttaaatgatataagccagccacagaatgacagctgtcacgttctcacttatatgtgggagtaaaaacagttgactcatggaggtagagaatagaatgatagttaccaaagtctgagatgggcgaggggtggggtggatgaagagaggttaatgggtacaaacatacagttagaaggaataagttctaatttcattgcttagtggggtaactgtagttaacagcaatatattgcatatttcaaaatagttagaagatttcaagtgttaaccaacacaaatgataaatgtttgaggtgatggatatcctaaataccctgatttgatcattacgcattgtatgcaggtatcaaaatatcacgtgtacctcataaagatgtacaattatgaatatattaaaaattattacagtggcgctgaacagtttctacacctagtgatgtcatagacattatagtgtacatagtgtgcactactcagcatgtttgtggtgatattggtgtaaacctgtgctgccagtcttatgagagcttagcacatactattatgtatactacataatacttgattataagcaactacctgttactgctttatgtatttattatagttgttatcattattttagagtgtactccttcttattaaaaagagtttacggtaaaacagtcccagacaggtccctcaggaagtattccaaaagaaggcattgttaccacaggagatgacagctccatatgtggtatcaccccactttccagtggggaaagatggggacagtggaatacagtgatattgatgatcctgaccctgtgtaggcttaggctaatgtttaatgtttgttttttaatgcttaacaaaaagtaaaagaaaatttttttttttttttttggatagagaaaagtttgtagaataaggatataaagtaagtaggctgggcgtggtggctcacacctgtagtcgcagcagtttgggaggccaaggcaggtggatcactggagcccaggagtttgcaaccaacttgggcaacatgacaaaaccccgtctttacaaaaatacaaaaattagctggacatggtggcgcgcgcctatagtcccagctacttgggaggctgaggtgggaggatcacttgagcctggaaggttgaggctgcagtgagccaagatcatgccactgcactccagcctgggcaacagagtgtgaccctgtcttaaaaaaaaaagtaaatatatttgtacagctgtactgtacaatgtgtgttttgagtgaagtgttattacaaaagaatttttaaagtaaaagaaattaaaaagtttataatgtaaaaagttacattgtggtaaggttaacattattgaagatagaaatttttttccaaatttagtgtagcctaggtgttcagtgtttataaagtttgtattagtgtatagtaatgtgctaggcttttgtgttcactcaccactcattcactgactttcttggggcaacttctagtcctgcaagctccatttgtggtaagtgccccatacaggtgtactaatttaaaaaaatcttatatattgtatttttactgttccttttctatgtttagatactcaaaatcttaccattgtgttacaattgccttcaatattcagtatagtaacatgttgtacaggtttgtagctaggagctgtagcctataccatatagcctaggtgtgtagtaagctatacagtctaggtatgtgtaagtacactttatgatgttgcacaatgatgaaattgtctaatgacatatttctcagcatgaatccccatcattaagcgacacatgactgtatcttaaaggatgtttcatatcagtacattaggcttagtaatgtttcattgtatgagtgtatcataatttatacatttttatatgtagccccttgttaatggacatttgtttctaattttttttgtgatgacaaatagtgctgcattaataacctcatttgtatatcatttcacttataagtccctagaagtggaattattgggttaaagagtgttatggcgttataattttgatattcctgtatttttctccatagagagtcatcaccagtatgtgagagtaactgcttccctataccctttgcaacacactgtaaatttttttatttttggcagtctgacaagtgaaaaatcgttacccacttttgactacatgctttcactcacaggggagtttgctcttccagcctaatgaccaaagacaacatctaatttgtatttgtactgttaggctgttttaaccctgattttccaaaaaaaatgtacagttcttagaggtaatcaaatttttttttttaaactgttactatgttgctttagaaatatctaggtttttttgctgggtctgatttgaaagcagtgacctgataaatttctgttaaccttaccacagtgtaactttttacgtacagtattttacaaacctgatacagtatcaggtttgatactgataggtttgtcagtctttttaagtgcccattatgtagtacctgtatttgaaaacctgtataattttgaatacatattatatgctaggtattatatttagatcacagcaactctttaaagaagattgtctgtgttgaaggctcatagaggtcaaacgatttgccgtagtatattagaatgtagatgctggtagagtcattaaaagagaaaaatacacatttggagttgagataaactgaaattgttaaacttgtgcaataattaaaagtattaactgagttttgttttgttttgttttgtttttgagacagagtcttactctgttcaggttagagtgcagtggcacgatctctgctcactgcagcctctgcctcccaggttcaagcgattcttgtacttcaatctgcagagtagctgggactacaggtgtctaattagccagcctaatttttgtatttttagtagagatggggtttctccacgttggccaggctggtcttgaactcctggcttcaaacaatctacctgccttggcctcccaaagtgctgggattacaggtgtgtgccactgtgcctggtctaaagtactccctgagttttttacaacacaaattctcattagtttaggacttgagttaagagtattaagagcagagattccagtctcaccatttacttgttatttgatctttaaattacttaattctccatgagcttcagtttccttttctgtaaaagagggatagtattataatagtacctaaattacaaaattcataaagcaaccttacctttttaaagattgtgtttagcctgatcatgtcattgttgcagtggttttttagcctgtttcaaaaatagagagcaagaaatagtgctgacttccttctcttttctccagtaaaacaagacaaaacaaagtatcagtttgttaactcacaaaatattgccatcacattttaagaccatttgaaattttcatgaacacataaattttaatatgacatagaagtagacagataacataaaaccatttgtcacgttttataatctatttaaattaggatggattttttggatcatattcctttgggaaaggcaaaatatttaaacaatattcctattccccctcagtttggccctatttggaagtaacagtatatctctctttcctcaataaaagaacagtaacaaggacagcaaacttcctcataaaaaacaacaacaacaacaacaagcagagtaccccccccattgttaagttgttaaaataagtctttattttatatcttgaaagctcaagattagggtaaggatcaagttacagagctgttttttccccatgcaaagtggcctggttcatattaggaatgaaactagtgactgtaatgtaattaagcactgtgttgtatagcactgcttctcaagttttcctttggggattttgctaaaatgaagttccagatttttggtgaggtctgagattttgcatttttaaaaagctccccagtattacagtgctgcacaaaacacagttttgagtagcacgtttctgtagcactaacccatcttttactcttgagtaattatcttaaatcatatgcttattttcagacattcattcagcagatttctgctgaacgtctatgtccctgacactatgctaggtactggggttactagggatgctgggtagatagtctgctgtcaggcaagtggggaagccaaagaaataacaacaaagtatatgtaactggtgatgggaaagtccagggagctgataatcttaagcacaaaaattgctttttgacagatttatgaagacagtgaacctagtttatctgataccgtgacatctaggttcccaatagacgtagaatgggggatattcattggatatcagtctagaatggttgttggcaaactctttctgtaaataaaaggcagggtagtaaatattttaggctttgcgggccatacagtctctgctgattactcaagtctgcgaaccaggtaacatgtaaatgattgtgtgttccagaaagactttatttacaaaaccaggtggtagactggatttggcttgcaggctatagttctagattggcagcatatcactcttcacttataagatatgaaaatagtttaaaggaatgatttatttaaaaaaagaaggtaattacattgataacatcactgcatcactgattcatttgcatttgaatatgctatcttggaacattagttgtttatatacctaaggatacccctgagaatatattatacatgtgattgtcatttgtcttgtatatcattggaggaaaaaaaagggttaaggtctattgcttggaactttagttagaactcctaaagagctgcacaaatgcccatttttcccttctattatatgggggaaagaaaccatgatacatagaaggagttatagaatttgagtataggtatgcagtgaagcatatctgtaaattgctttttctggacaatattgaaaactgtgtaatccccagaccagaagaggacatccctggatactcaatcagttaccatcatttagggtaatgaatataatttgggctctggagtttaccttttggtttcatcacttaactcgtgtgaatttggcagagtagttaacctctttgccctcagtttcttcatgggataatgatactgcaacatacttttgaaaattataaaaaacacactatatttgatagcaactagtatagcactagaaaatagtgagccttctatagatgttacttttcttctcttctgacctgcctgcagtgcagtttactaatgtactgaaggaaactgaggaaaaaaatgttcctggcacataagaatcttaaaattgagcaatatactaatgtactgaaggaaattgaggaaaaaaatgttcctggcacataagaatcttaaaattttcttggagttgtatataaaaataaagaggaacactttcaaaataacatgcaaaccaatgtaaggcctctcaatagaggtatctcaaacaggtaaaaatatcatttagttgtagaactaaaagtcttaggacttctttaaattcaaacccttatttttacagatgagatcaaatgactttccctaaatgctgatatgttgcctttttgtgtggagaatttattctctaacattcattgattaaccagatgctgttgcctcttggttaggaatttaagttaaattcatccgtttcagtttaagcaccgaacaacttgttctacatggtttttttgtttgtttgtttttgtttttttttaatttgaggcagagtctcgctctgtcgccaggctggagtgcagtggtgcgatcttggctcactgcaacctctgcctccccagttcaggctattctccggcctcagcctcccgagtagctgggattataggggtggccaccacgcccagctaattttgtaattttagtagagatggggtttcaccatgttggccaggcgggtctcgaacttctgacctcaggtgatccatccacctcggcctctcaaagtgttgggattacaggcatgagccacctcgcccagcctgttctatgtgtttttaatacttaggaagtgttgatacatataattttctggccttaacagagatggttagtagctattcataggtctgactgtaaattaaataatttttatttatttatttactcttttgagatagttttgctcttgttgcccaggctggagtgcagtggcacaatctcggcttactgcagcctccacctcctgggttcaagcgattctcctacttcagcctctcaagtagctggaattaacaggcatgtgccaccacacctggctaatttttgtattttagtagagactgggtttgaactcctgaccacaggtgatccgcccacctcagcctcccaaagtgcaaggattacaggtgtgagccaccgtgcctggcctaataatttttatttctttaatattgccactaggaacaattttctgtgacatttttgtagctctgtagttaaactaacttggaatttctttacagagcttagaatttacaatactgttagtctctttgagttgtattagtagaaaggaaaggtgacattaaatactgacaagcaaaaaatataaagtaattgctctttggcagctttagtcatgcctcctatatctgtctcattttgccttggttcatgccctcgtcttttctttcttgggttattgtagttgtctttcagatggtttccctttagtcattcaataaataagtggtgacacatgataggtacttctaagtgcggtgagttcagcagtaaacagatggatcaacctccctgccctcgtggagcttattatttagcagactctagctctgtactttgagagcttccctctctacttttgtctgagtgctatctctaaaatatgtcctcccagtgttcagaatcctcaagtgcaagtggagtgggtttctattgtcttttggacaaggttcgggcttccttgcctttattgcaacttcatctcttgccatgctcttcttaaccctctgccttccagcacactgtagtcccttgttggcaccacactgtcttaacatttttatacatatatttctgtctgcaaattcattcctttagatccccccaccccaacaaacaaaaacaaaaatagcgaatattcatcttttaagcctctttgacttacccactactacctctctgctttggtgccatgactcccttcctttataaacaaatatattctcatggtccattaggcatactgatactatgacgtttttctccctgtattatgatagtctgttcatttatctgcctgtcctactagaattaaaggcaaaggctgcttttttgtttatttttcagtgtctctcaaggggcctggctcatagtggtttgaaatattaattgaacaaatgaatgaatagcccagacttctactatctcaatgctgtcaacctgacaacgtgcgggggattcattcagtaaccctttaaattagtggagtgcttattactatgtgccagtgatagagatacatagataatctgtcctcagatgagtccactgtaaggctgacagcttccttattttcacagcatactgtcttttaaattttttatatatttattagaaaactaataagtagtctctatcaagtatctaaacaagtgttgagagtatctttttattgaagtagtggcttaaactattgaagagatattgataaaaatttggggaaaataaaagtgtatgtagtgctaatttttttttgcatccctcagagatccagagtcatttggatagtttagtaatatataaaatatattttgaaaaactgtgtttgttaagtttttagtatctttaaaaatgtgaaggctgataaaattttatttttctaattaagaacaaagttttgacctgtaagtgctacccttggagaaaaatttcttctatctccctcctctctttatagtaaagccatctacttgtatatctctgtatcatatatgtcccccttttttaaacagtagatttagttgttctcacattacagttctctttgacccttattttatggatattacagtttgacttttgtatttacaactgttaatctctcaacctgttttatgtttatgtggacatgttaagtgttttgtgtacttcatgatggtttttcaaatatgattatacaaatatccttggatataccaaatataaatatattattttgaaaacaactgttagaatatacattgtgtgcaaatttgttataagggaaaggtttaactaattgaaatgaactttgctattaatttttatattgcctgcatttaatagtaattttaaaacagtaagaagagagttgtgtttctcaaattgcttccttggcacgcagttcctgaatgtgttcagagaacagtggattccaaggcagaataagcatagcaaatggtacatattcatatttcacataaacatagcgaaggaactgtggaattcccacctctacacctgtttaactttgctaacttaacttatttgtgtaagggaggacaacctcccttccctcatctcttgcctcccttaagacctgtttgggaagcactgctgttaacgtgcagtttctggggctctgatgtcctggtaccttgccttttggttatttaatgggagttaagagtctttgcctcatctgcatttgcattaaaatgtctgtgggagttacttcaaggggaaaaatgagctagtctgtttcaattggaaaagtctatgtctagagtgtgtctatatgcatgagcaaactttgctatttttaaatccctgtgtgaacgtcagattttttggctgttttggcttattgcagtaggaatagataaattgatgttcagctcagttgttcatagcattgcatgggacaaaaagatggttactacaaaattatgaaatcaaaatgctttttgaaaacctaaattttcaaatgaaaaatatccttcaacatacatatttagctcaccctttattacctgtttctctgctgaaaggatagaatagtacatatgccaggagttgaaatttatctatacattgaaatttatacgactgtataggaggttgtggtttggcagcaaaagctttctagatcactaatttgtaagcgccttgaaggtaagtgttcagtgtctcttacatctttgtattgcccacaggcaaatgctgttttatgagtggcagtaatttgtattctgaacttaaggcaagaaagactttgtataggatctgcttttaagtgctgtcgtggtatctggaaagttgtttgcatagttacctccttatctgtctgtcctcttggcttcctagttctgctttccccccagctcatccatgttgaagggatctggctatagattgcaactctgcttactgtagcatagggctgccagcttggtagtccggattctttttagcacagaaggggcatgagaccacattggacatattacttgtgagctttgagaagtttttgtggataacattggcagacaacctctgactttgacattatagcctactctgttatattgttctcctctcttctgccttactatctcccttcatgcactggttatcccatttgaaatagtgtttctggaggcttaaagatgaggagtagttgaacagttatggacagtgatttctcagctccttagagaactgaacccataatctatcctttcctagcgtaatcctgaacctgtaactacatttaataactgcatgtaccgaagtatttcaagtaatcctgaacctgtaactacatgtaataactgcatgtaccgaagtatttcattggatcacatactgctccagcttctacttcagtttctacctcccttgtatatgaggtcacttattctagttgagtaatatctctgaatttcttcctttatttattaaaaaagtgctaatatgctgtcctccgagccccatttaatctttttctgttttcttattttccttgcttctctttagccccccgatctgtccttgtcttattgctgtaacctgctgccccttattgatcatacagtggattgaaggtatatttgttgacttaattatctatgtgttttaagaaactggttgcctgaggcatttctgcgtgtgtgttttaaaagagagcatagcctcttgatctcaagccaaaaatgtggttcatttaactggtattttatcttcaattgatttttctgtggagtttggccttggatatatatagtatgggtatagatgattgtgaatggcttataatagctgattacagagtatggcccagaaattcttttgctttgtactgtgtatggaacagtttggtatgaaaattaactgtagcaaaagcatagttaactttaatagcatatctggcatctcttttctcacacatcacgtctagtacagtagcaaatccttttggctctgccccttagaacaggggttagcaaattatggcccccacctctttatagttcatgagctaaaaatgttttttttttaacaattctaaatggttgaaaaatattaaaataatatttcaaacacatgcaaatcatatgtaattcagatttcagtgtccataagtaaagttgtattggagcacagccacacttgttttcgtttctgtgttgtccaaggcttctttcacggtaccgcggcagacttgagtggttttaacagagaccctgtgacctcagaactgaatatatttactgtctggtctttacaaacagtttgccaaaccctgctctgttgtatatccagaatctagcactttttacttccctcttgactaagtcattgttcttgcctcctaattgaactccttgcttctgttcttgtccctttaaatctgcagtcagtggagtgatctttttagaaagtaaaccaccctctgtttagataaaataggttaataaataagtaaatatcaaggacagttttgaatgaaaattatagaaggaccattaatcttggttaggataggagcaaggaaccccatatattgtgtttaaatgctgatgaatacagaagtgaccatacatatgtgtgcatgagcatttgtaattgaaaaaaagcagagccaaggccgggcgtggtggcttacgcctgtaatcccagcactttgggaggccaaggcgggtggatcatgaggtcaagagatggagaccatcctggccaacatggtgaaaccccaactctactaaaaaatacaaaaattagctgggtttggtggcatgcgcggctgagacaggagaatcgcttgaacccgggaggcggaggttgcagtgagccaagatcgcgccactgcactccagcctggcaacagagcgagactccatctaaaaaaaaaaaaaaagaaagaaagaaaaatgacagagccacctccctctgtattgctatatttatttatctataaatttacatgcaataatgcattcttttctgtgtctacttttatgagttttgataaatggatagagttatataaccaatcaccacaatcaagatataggaaagatccattatccactaaaaaaaaaaaaaaacttgacttttgtagtcatcaccctcccccaaccctggcaaaccactgagctattattctccctataatattacattttccagactgtcatataaatggaatcaagtatagttttttaagtttggcttatttcatttggcatcatgcatttgggattcatccatgtagttgtcaatagtttgttcctttttgttgctgagtagtactccatggtgtggtaggtacaccatagtttgtttatctcttcccctattgagggacatttggtttcagtttttggcaattatgaataagctttctataaacattcatatataggtttttgtgtgaatatagtacagtagtttcctgtggctgctgtaaaaaattgcgaaactggatagctttaaaacagcagaaatttattccctcactatcctgagggtcggaagtctgaaattagtatttctggactgaactcaaagtgttggcagggacacattgcccctgcaggcattctgagcttctggtggctcttggcatttcttggcttgtggtcagcagcagcatcactcccatctctgcctcttcacatcatgtcttctcctttgtgtgtgtgtcacctgttcctctgcttctctagggacacttgtcacaacatgtatggcctgcttagataatccaggataacccccccatctcaaaattcttaatttaatcacacttgtgaagacccttttcccaaataaaattatcctttacaggttcgaaggattaggatgagctgtctgtgggggatttcagtctactactctaggttttcatttgacttgggcagatacctaggaggtgtgttgctgggttgtatggtaatggtatgtttaacttttataagaaactgctaagctgttttccatagtggctgtactgttttgcatgcttaccagctatgtatgagtatctcatttattcagactcctcactggtacttgatattgtcattttaaaaagccgttctaatagatagtggtatttcattgtgattttaatttgcatttccctaacgattggttgtgtgaagcatcttttcatgtgttttatgtacatatcttctttggtgaagtgtctcttcaagtagtttgcctatctttttcagggggttggatttcctctttgttattctttttttttttttttcctcttctttttttccccacacctctgttcttcctaaagttagttttgggctccagggaattgggaagatatttgtgcttttataatcctctgtatgcctcaatatttccttgccacaaacttgttctgagtttcttattcttttttttttttctgagatggagtttcactcttgttgcccaggctggagtgcaatggcacaatctcagctcaccacaacctctgcttcctgggttcaagcgattctcctgcctcagcctcctgcgtagctgggattacaggcatgcatcaccacacccagctgatttttctgtgtttttagtagagacggggtttctccatgttggtcaggctagtctcgaactcctgacctcaggtgatccacccacctcagcctcccaaagtgctgggattacaggtgtgagtcaccgcacccggccgaagtagtgatttttaactgtcgatcagcattgtgaatactcatttctagaacaaatggtctcatttactagtctattgaattaaagaaggtaatgtaggaacttgaaagttggggttcttattttcaagattttttataaagttgagtatctagactgcaaaatgtgtcagtggttttagagggaagaattagcttttcattctgagtttctaaaactaggtatattagacttgggttcttttctggcttttgatagactttctcagaaaataaaatataatctaaattaacatgtaaggggcatgttaggtctggggttgcaagtgactgaagcccttgagtaaaaagggcgatttgttagtgcataggaccaaactgtaaggaatgatagggatggaattggtttttggggacaactgatctgggaattagattattgcctggattatctcctcttatctctgctctctctttgaattgattacattgtttcctgtctcagatgagttttctccaaatgattgggatcatggttgctggtgttttaggactcgtatccttctattttagtgaccccagaggaagaaaagggaccttctttgccagtaggcttaggaaaccctggggaagcaaagaagaatctggtgtcaagaatggttgggcacatagtagagcacaaacagtttataatgctggctgggagtgactgctgggttagtgaaggtgtgggccataagatttgttacacaagccagatcacttttgagatgaagggaagtactaggacaacagatgtaaacttgggctgtctcacataccccagtgatggggaggtgataatcagacttgttgcacagtagggcgccctgaggctgagggtttggaatcgtgaagagacttgcctacgtgtgtgtggaagaaagccaggcagagctctgggttttcttgaatctttttgaggcaacccaagatttctgtagatctgccctaattagtaaatgttattgctttatggataaagttgaagtcctagaatctgaacccaatttctactttctcataggaaactagttctgtgctctgatacaatgtttactcaacaagtacatagagtgtctgatctgcagtcttctggcctattgtcaatagatggtattgacaataccagtcacccaggctggagtgcagtggtgcgatcttggctcactgcaacctctgcctcctgggttcaagcgattctcttgcctcagcctccagagtagctgggactacatgcgtgcgcgaccacaccaagctaatttttgtatttttagtagagacagggtttcacaatgtttgccagactggtcttgaactcctgacctcaagtgatccatctgcctctgccttggcctcccaaagtgctgcgattacaggtgtgagctactgcgactatcctgttttatttatttatttatttttttctgttgggtaaatctgtactttttctttaatgagacctgtgctttttacaaaggattgtggttttgtttttttttgttttttttttttttttttttgagacagggctttgtcctgtcgccaggctgtaggtgctgtgatcatggctcactgtagcctctgttttctgggctcaagtaatcctttcacctcagccttttatgtagctgggaccacaggtgcatgtcaccatgcccagctaatacttaaaattttttgtagagacaaggtcttcatatgtttcccaggctggtcttgaactcctgggctcaagcaaccctcccacctcagcctccccaaatgctgagattacaggcatgagccactgcacctggcctgacaaaggatgttaatgtttaatatgttgtggaaaaacagaaaaaaaattaaaggttttgtgaagaatgtaaaatgcacccacatgcacccattagtcgtctcagggtcacatgtcaccttttccatgaagatacttgttatggtcttttatgtagggtgtttttttctttttaaacttacatactagattatctgcacctagcacagtggtgctgtatatggttgttcagcaagaatccagttcctgtgaagtttcctaagataacagcataagataatatttaaaatttttattttcatataaactaatagcattaccttttaatattttacttcagattactttatggttcctgttcttttattcaagttctgcagatctagttactgttatccccattttatggtcaaggaaagagacacattgtagttaactaactgattttctctctgatgtagctagttatttatatgcaatgttctcactaatgtattttccgcaacgaattaaactaaaacttgagagcgtgatattaaaaggtgaatgatgatatgtgatttgagacacttggtatgaaagccagccttgtacaggggtgctgtgtatgcagagtcatttactgtagagtttacattaaaaattgattttcaaggtaaaaaattgctctcttcatcttttatattgctttattcaccaacttttaaattacaattttaaaatgtcttctatatatagactttctagaactaaaccagtacagttgccattaggtgcatgtagctatttaaatttaaattaattaaagttaaagtaatgataaccactagcacatttcaagtacccactagctcacatgtggctagtggttacagtattggacaacagagatatagaacatttcatcatcccagaaagttctactagatggcactgttcttgagaacagtgttaaaaaaatgtcactcgaggggccaggcgcagtgtctcatgcctgtaatcccagcactttggaaggccaaggcagaggcaggcggatcacttgaggtcaggagttcgagaccagcctgggcaacgtgaaaccccgtctctactcaaaaaatatataaaacttagctgggtgtggtggtgcacgcctgtaatcccagctacttgggaggatgaggcaggagaatcgcttgaacccaggaggcagaggttgcagtgagccaagattgtgccactgcactccagcctgggcgacagagtgagaccctgtctcaaaaaaagaaaatattacttaaggatagggtttcagtttttaggctctaggatttttggagttgaaaatgttagctttggattatcctaatgaggggagctttgtgagttactgtctgtggatcaagcctgtcatgttcacactctgcctaatcttttactagtctctctggctctgtatatatcagccatacttggctgagggttttttttggggggttaagtagtacagaatttgcaaatgtttgttttatgtagttaaagccttgatgcttagtatcttttccttatcaataaaatgaagtaatgagatactgactatatggaatttgaattaattgattgggattatgaagttaacaataaaaattttttttttttttttttttttttttgagacggagtctcgctctgtcgcccaggctggagtacagtggcacgatctcagctcactgcaagctccgcctccctggttcacgccattctcctgcctcagcctcctgagtagctgggactacaggcgcccgccatcacacccggctaattttttgtatttttagtagagacggggtttcaccatgttagtcagggtgttctcaatctcctgacctcgtgatccacccgctttggcctcccaaagccctgggattacaggcttgagccactgcgcccggccaacaataaaaattttaatgaactttctagtcctagtcccaggagaaacctttgctgtgttttaaagttaactcaacttcatctctcattctctagactcctcagcccttaaaagctcagtttagtgccttatagaactcagtccacacatttcttaagtaactgctctggaccagtcactgtcttacataatttactaattcatttatgattatctttaactagataatgaggtccttgaaagtaagaaaccctgttttatactataattttagaaattaagaactgaaagagactttagagctagtcatgtcaaatattttcattttacaaatgaagaacccaggcaggttaagtcagttccccatatttggagaattaggattaaagaactagcctttcatcagactatctactttattggttgattgttaaattaatctgaaggaagttctcagcactactctatgttgaggattctatattgtctatataaactgtgtcattgtagaataataaagttatttataactcctgatttcagcacacggtatttcctatttgtttcttatgacgtgttcttaggggcaaattgcatgatagttttggagatacagtattatgaaaaaggcatttttggttttagattagagtaagttgactgatttttttttttttttttttttgagatggagtcttgctctgtcatccaggctggagtgcagtggcatgatcttgactcactgcaacctctgcctcccgggttcaagtgattcttgtgcctcagcctcccaagtagctgggattacaggtgtgcatcaccatgcccagctaatttttgtatttttagtagaaacagggtttcaccacgttggccagtctggtctcgaactcctgacctcaggtgatccgcccacctcggcctcctaaagtgctgggattacaggcatgacactgtgcccagtcaactgatttcttaggttaaataaatactcctggtttatatcttcatttattatacttgctagtacaggttgagcatcccaaatccaaaaagttccaaagtctgaaactctttgggcgtccacatgactctcaaaggaaatgctcattggagcatttttgattttgaatttttggatttgggatgctcaaccagtgagtataatgcaaatattccaaaatccaaaaaacatctgaaatctgaaacacttcttgtcccaagcatttcagagataagggatacccaacctgaggtgacgtaacgtaagatgttacggagttggagtgtccatttatagaagcaaataggcctgactgtttctatgagctatagagttttgatctctagttttacattccaggtacagttttggttttgatattactattgtgtacacacatgtgcacctgcacacacacacataacatactcccagacacctacttacaagagtgctaagaacaggaaactgtcctaggtgcagacaaggctagactcttctagggtccctaaactgtttcttaaaattcgtttttattcctcctagtccttggcaaagtggtgggtgtatattaggtattaataaggtaattgttatttgatggtatacttttgcttcacagaaactttgtttatttctgtggtagcatatgcttgtagttgtcagggaccagatcagctcaggcttttttgcagaatacaggttatttccccatagggttagtatccccaccttcttcccccaagaactgaaatcattttcagaagggagtcattgcttctggatcaagactttaattatgggctttttttcaaaggcagttcccttttctgcagttgttctttggatggatggatggatggggagaaagagagtgagtgtgtgtgtgtgtgtgtgtgtgtgtgtgtgtgtgtatttgcttgcagcatttgaatatgtgcagcacattggctttctagacatcctttgtatagtaacagcatgtgtggaagggctggcagcctgtaaaacagtttttctcctcttccccctccttccaacctcactccctctctggatctggtgacattacatagataaatgtgctggctaggaaaacagcagaaggagttgaatgtctgccaaaaatttgcagcatgaaaccaagctggctgcttcagcctcgctttcctgatctcttattgtgtgtgtgcagtctgcatttgtcagggttttccttattgagcattacgtcactatgttctccacccttatcacactggcttttcttttgaaagctactgtcctcaggcttcaaactcgttaaacacttaaggctttatttatactgttacggaggtagtattgaagatgaaatatatttaagtcagaaattttaatttgatgcaatattaacttagagtatgcttttgtgtgtttctgggcaacattagggtagtgtagaaaagaatatcttctgaaaggactttgaagacagaaaagtactgattttttttaaacacgaatatttataatggctttataagaatcaaaatctggaaacaattcaaatgttcctcaaatggggaatggactgtggcctagtcatacaatggattgttactggcgatgagaagtaacaaactatgacacagccattaacatgaatgaatttcagatgtaatctgctaagcaaaagaagctagacttacaaggctactgactgtatgattccatttatatgcagaaatagtgccttttttttttttagagacggagtttcactcttgtcgcccaggctggagtgcaatggcgtgatctcggctcattgcaacctctgcctcccaggttcaagtgattctcctgccttagcctcttgagtagctgtgactacaggcgcacaccaccacacccggctaatatttttgtatttttattagagatagggtttcaccatgttggccaggctgctctcaaactcctgacctcaggtgatctgttcgcctcagcctcccaaagtgctgggattacaggtgtgagtcaccgcacccggccgaagtagtgatttttaactgtcgatcagcattgtgaatagtcatttctagaaaaaatgatctcatttactagtctattgaattaaagaaggtaatgtaggatcttgaaagttggggttcttattttcaagattttttataaagttgagtatctagactgcaaaatgtgtcagtggttttagagggaagaattagcttttcattctttgcagagtctggtgagagtgcttgaatccatgtctaaaaaaagggctttgcttactaaagctttatgtagttacttaaaaaataagtgtgctcctacttctttttttcctgaatccttcaggcttatacagtttaggaaccattaatttgaatcagttatttgggcaacttacctgtaatattttcattatgtttgttacttagcatatgctatcctgtattgtaatgttaatgcacacgtcttaattttacaactagatcataagacccagcagcagggagctagttttattatatatttgtttctctagcacctaactaaatatccttatacacaataaatactaaagataatggtctgtgtaggtaacattgaggatatgaatagtatgaggtgatttcactagctgactactagtatgctagggctgttattacagaataccgtagactaaatggcttaagcaacagaaatttgttttcttacaattctggaaactggaagttgcaaatcaaggcaccggcaaggttatcctctctccttgtcttgcagatggtcacctttttgctgtgtccacacgagcttttctctgcgagtacactcctgatttctctttctcttataaggataccagtcctattggattagggccccagctttatgatctatttaacctcaattacctctgttaaaggccttctctccaaatagagtcacattgaggaattagggcttcaccatatgaatttttcagggagcaaaatttagcctgtaacaatgacctcctgaagataggtaggtatgccaagttgctaagatattaaatagaatccacactagatacttcagtaaagaaaatgatgtatagggaattgataaagcagatgctggagaactgaaatgcaaaatggaaaattgaagtaacaccaaggtaataacttcctgaatcagctacaaccccatgggctggggaaacaaaaaaaaaaaaaaagaggtttgaattattggaagcttggaggaggggctccacagagctgagattcagacttaggaggaaggcccgctgcctgattgctttcaaagacttgagcgagaggccccacaaagttgggtctcagatctctcaaaaagatgtcttgccctgctgctgttgggctttctgagggcgcatgggaagtctagttctgagagctgaaggaagctgaagactggaaacaaccgtttctcctcggaaagggccaatgctagggttccagtggcaggataggagatagcaaggagcaagtccgttcttttgtcacctttacgttctagtcttcctctagtgtgttcccggctggtggagatgaatgggaagccgcctgacaggagaaatgaagtgtgcagaatctgagccccacatcataaggcccggtagagaagagtgaacttggacttgagacacagcagcttaatagatggtactattattggcaggagtacagcctccctgaaattcactttggcagtatggatcaaaaatcttagaaatgtgcataccttttggcccagtaattccagttcaaggaatatgtcctaaggaaataatccaaaaagtagtaaagatgtaagtacaaagctgtttgactgcaatattgcatataataaaaaattagaatttaaatgttcatcaatatgggattggtcaaattaccttatagcatttagtgaagtgttatatagccttaagaaagatgatattgatttggatttgttgatgtggaaatagaaatttaacaaaaaaacagattatactccatcctgctgtggactcgtctgtgtttatgtgtgggttttttgttttgttttgtttcgttctgtttttgttgtttgtttttgagcagagtctcactctgtcacccaggctggagtgcagtgatgctgtcttggctcactgcaacctccaccccccaggttcaagtgatactcgtgcttcagcctcccgagtagctgggattacaggcacacaccaccatgcttggctaatttttgtatttttagaagagatggggttttgccgtgtttgccaggctgattgttttgttttgttttgttttaaatctatgtaaagaaaaagctgaaaacaatatacaggaaaagagacagtacatcaggttgaagaatgcaggctctggagccagactgcctgggtttgtatctgggctgtgccacttacatctttatgacttgggtaacccaaattaatctttctggggatgtttcctatctggaaagtggtgatgatattaccttccccataggacagttgtgaggtctgaaggtgttaatacctgtagagcatatagaacagtgcttgtgattaagttctcagtagatgctggctattaagaggaggaagcaaaagattaggagagaattttagtcttatctctcgttttattataaaaattttagtatgaatgttacgattttataattggggtaaatagtgaagcttttccattaaaactaaaaacaatgaagcagacaaagacgtactaagtatctttgcatacatgtaggagacctagaactctaagatgctctctttataggtaaccaagcatttcctgctgcagcctagatatagctgacaactgaggcttgtcttttgacaagcccctattccttgttgtaggagaatttcattcttctcaagatctgtacagatcctcaggaacttgcattgttaagcttacttctggctaggttcccaaggccttcatcttacttttgccctagctctttgggtgtgtctcttccctctgctctgcactgcacagaatcaaacttaagccccatgccttttaaaaaattactgaaaaatgacatacttgtttttttagtgggctgcaagtttcaagatttttattgtagcatagaaaaattttagaatgtagtcttagacagttttttgaaaagtcccttgaccatgttgcctttaggaacttgtcactagctgccacttactctacatttcaacctccttccacctttcttgaccctctcaatgccttgtcttagtttcttaggcagaaaagtttttgtcttacttagttacagagacactaatgtgctgtgttaaaataaaaggtcttattagttacatttaggaacctgctttggttccatatttttgtctatcttttcccctttcttaataattctctgggagtggaaaaagggagtaaagattgatttctttttgctatgaataatgctgttctttgaggaaggcagcagagaacctctggtcagtatttgttttaaatatccaagtttaaaccattctacactatattatgttagtatcactatttaccaataatagaaaccgagcattttctacctgtaaagcctccttcctcctccttccttccctccttcctctccctccctcacgttttatctatagattgttcacttgagcaactgagttgaaaactgcataatgtatttagagttatgaacttggagtcagaatatctacctgactttgaatgtcacttttgtcactttactagtcatgtgcaccgtttgacagtgattttttttctttgtttaactgaggagcgtataatgatttttgcagatccctttcagttccaaacatcatgattctgatagcagaaccttgcattctatcagatatgtatcagttattgttcttcataggtcttgaagaaaatgatgctatatgccgatttgttcacgtgttcttaaacctttggccgaaataaatgcctacaataacaatattttaaaaatttaatgaacatgaaagtcttgttgaacatcttcttctaaaacatcacttttttttcttttttttttcttctgtttttttgagatggagtcttgctctgttgcccaggctggagtgcaatggtgtgatctcggctcactgcaacctctgcttcctgggttcaagtgattctcctgcctcagcctctagagtagctgggattacaggcgcttgccaccacaccccgctaatttttgtatttttggtagagacgaggcttcaccaggttggccaggcaggtctcaaagtcctgacctcagatgatgcacccgcatcagcctcccaaagtgctgggattacaggcgtgagccaccgggcctggcaaccatcacttctgtatatattttagcatagaaatattcttttgctaatgctcttatactcaagtaccactaaattatttttttaagtgggtaatatgcagtgtggcaaatgtgtatgtacaaagactttaaaactcttaatgcagttgcataagtaaataccatatatagaaaatttcttaggccacaggaaattttaatgaacttgcctatttcaggaagttaaaatagaactaaaacttgccctgagttaagaagtggcaatcagtcagttaacaaaaataagctttgaaggatagatacagttttgaaaaaggtgtagcagaaactagcacttactaggtgtttcttacatttgaattacacagccataactttatctgttaatcttcacattaacttgaaaggcaggtatgttgtacttttcaacacttaagtaacttgcttaaagtgatgccacagtggcagaacccagtttgtttctaagtgctgctgaggtgattcttgtaggtggagatacaaacgactttgagagaaggggtaaaataccctggagaatgagcgtaaagtatgatttctgaagatgaatgagtagattgggaatagaggaagatagagtgagaaaggtagtttagtatataaaggagggaattgaatgccagcctgtgggagttgacagttgagatatattttataagttttgagccaggcaaatgactggataaaaatagtatttaaggaggattaatctggtagcaatatgcagaaaaaagtcaaagaaagagtagagggagtcagtctatggaggagattgcatatggtgacatgactgagtcaggagagaggtacaaacatgtaaaagaaactaaagtagaaagaaaaggaccacaaaggaagggagaggcaataataatttgtaaatatcatccagtatttggatgaatgaggaaatgtatcactgacaaatagaaagtggagctttcaaataaccactaaacctgtgaaaggaagataacgctttgcagtttcttaacttagaatttaaattcagcaaatatggatattgtcatttttgatgtcacttctgattaagaaatagaagattgttagagtatcttaatagatgattgatttcttatctgaatttccaataatctacatacatagtaaaagtggaaattgaagtttatcattactgatccaattatatcattaactttcaccagtaatcttattgatgtctaattgtagaagtcattgaatgaactcatcataataaaaatgaattcaatttagcatccctattaaagttttgtaatggctaatgggttatgttggaattgattaaaattatagaaagttatatactataagtaatggaaattataggtcttttcccaggccattcattttttttttaattattataaatcttttgcaggtgtgtacttttgagaacagcttatccttaaaaatgtttaataagcagccatagagtacttgatagtatatgggatgctgaagaatttaaagagattaaagtccacccagatatagtttccttgaagatatagaatctaggaggaaaggctctgagtaagtaatgataaatggagctaagcatggtttcattgcattttaatttcaacaaacgcttacttagtatatactaagtgcaaggcataggtgaattaagtggtgatatctgctcacctaggatatcagtttggaaaaggtggctaaaaatggaattcaaaactgtcagaaaggatttggtcagagcatgagttcatcaaaggctattattagtgaaagaatgaaaaacttggtaaaattgacatgaagagcttgcctgagtggaagagaaccatacgttttagaacattcagctttctcaaagtatgaacactttccaacaaaggatgagtttcctaaagggaatatgtgtgcagtttgttactcttatgatattggaaataacgaattttgcagagattcttccagaaggcttacttttttggtgtgtgagtgaaaatatgaatggtacttaattggtttctaattgttttgtgtggattttgtctttgaattgactgacatttataagtgctttgaaaatgtgagtacaaccttttctttgattgattcaaatttttatgttatgttaaaatgcccaccaaggagtaacatttactagacttcttactgtgtattgggttatattttgacaacctagcaatactcgttttcctcatgcccagtcattgagcatcattttggtttccttcactataccatgcctgaaaatagtccaattttccacccttctaagcttaagacttaactcctcttaatccttcaggtatttgtatagtagagtgcttgtcagtagatgtttatcagcttatagataatgtctctgctgaaaattatttgtttcaagttctgtgaaacaaatacccaccgaagaaagttaatttcaagttaaatttactttacttgattatagaagaagggagtaggatgaagtacctgggagccactagaggactggagaggcagtctaggttgtagttgtagagggatagatttgagagaagcttatggtggtttatgctcagagtaacctggatggataagatatatggtggtcagaaagaattttttgtttgagactgaaaagtgtttgatctatagatttaattcttaaaaatttttcttaagacaaagtgagttgtttttatgcaattggattaaaagataactaacttccatgtaggtacagtgaaaataaaatggctaacatttaaattcagtagccaaatataattgttattagtaacttttttttccatttttgatgggctacaattatatttctaattctgtttactgcataccagatttaacatattcctagggttccacaggaatggttaaaaatacaggtttcaagatgagaacaaattatagtagttgcttttcattgcatgggttttgacctattacttaaatcatctgatttgtgagaatatgaaaaatctatactaattggttttgttcatttttatattgtaaaatttatataaaaatttaccattttaactatttaagtgtataattcagtggcattaagtacattcacactgtcgtgataccatcaatttcttttccatccattcagaacgtttccatcatctcaaacagactctgtatccattaaacaataacttcccattctccacttcccatggcctttggtaacctgttttattttctgtctctatgaatttgtctattctaggtacctcatataaatggaatcatataatatataatatatgtccttttgtggtacactactagattttaaagaaacgagttgcaataattatagttgaacataagttttgtgtatgccttagtctgttttctgctgttgtaacagaatgctacacactgggtaatttataaagaaaatatgtttatttggttcatagttttggagactgagaagtctaagatcaaggggcctcatctctctgtgagggccttcttgcagtgctataacatggcataagggcagaagacagaagcgagcacgcaagacagagaggaaaagggggccaaattccaacgataactagcccactcccctgataacagcattaatctagtcatgagggtggagccctcatggcccaattaccttccgaaagcccccacctcttaacaacaccagacttggaggggacattgaaaccatagatactttatagatgttttgtatttaaatctatggtaggatgtgctcattatccttttttgttgcttagtgcatgtttgagtgttatagggagtattacatgaattatatgtgtacttcttccatactcttttaattggatatgccagtgtgtctcagtaatttccagtggctgtaaaacttgagaaattttgtagcttttagaaaccacatacctgtattgcctgattgcttattaagtgatctcttagaggtttccaaagttatgagtttgagtttacaagtgcagtttttttccatgaaaatttcagtggtgacaaattatagaatttatcattcaattcagtcttaactagaaataattgcatataataaaacaggttcttgactgttctttttgtcagtgtttaagaatagagacaaaataaagttagatttgagtgcctcagaagatattagaaaatagagataaggtttatggcctttaaaaaattaaagacagtattgggggaaagaaatgaaaattgggaccgggcgtggtggctcactcctgtaatcccagcagtctgggaggccaaggtgggtgaatcacctgtggttaagagttcgagaccagcctgaccaacctagtgaaacccccgtctcaactaaagatacaaaattagctgggtgtggtggcacatgcctgtaatcccagctactcgagaggctgaggcaagagaatcacttgaaccaggagatggaggttgcagtgagctgagatcacctcattgcactcccgcctgggcaacaagagcaaaactccatctcaaaaaaaaaaaaaaaaaaagaaatgaaaattggactttttagatgggaatatctcagatgatatatctgtgtatctagaaaatgtcattatttaagatattctaaatggttatgattaaaaattatttcatggtataaacttcaacagagagcattgggcaaaatttttactgttcctgtttttaaaagttcaagtcagaatgcctgcttgttaccgaatcatccaccctgtgtttgcctcaatactgccatctggtgattattatagagatctcaacagggtgcttaaaggagatgtagggcaaccgacgacacaaggtacacaatattggtgccctctgcctcaaatctccctctgcttttgagttgctatggcagaaatcttacttagttatggccatgaaatcactttgtgagattgctttgtaaacaatagagcatttctgtactgctgtgattattactgcactacacatggctttttatcaggctcatacccaactcattgttctttctatgtaaggtactcttattatatctagttctacaaggtaattcaattaattattcagtaatacttattgagtgacttctatatactaggcattgtttttatttttatttttattttttttttgagatggagtctcgctcttgttgcccaggctggagtgcagtagcacgttcttggctcactgcaacctctgcctcctgggtccaagcgattctcctgcgtcagccttttgagtagctgggattacaggtgcctgccaccatgcctggctaatttttgtatttttaatagagacggggtttcaccacgttggccaggctgctcttgaactcctgacctcgtgatccacctgcctcagcctcccaaagtgctgggattacaggtgtgagccaccgtgcccagcctaggcattgcttttagtagtaagaatatggtcctaaaaaacaggtgaaaatcagagtcttcatagaagttacatttagttaagaataaataataagatatacatacacacatgttaattagtgaaaagggttaaggggaaaaaacaaagcagggaaggaacttgtgaattattggggttggtgggttgctttgaaatgctagatggggtgttcaaaaaaagccttactgagaaggtgacttcctgagtagagatctgaaagatcttgggacgaacattctagatatagaaggaaagcaaatgcaaaggccctgtgcctgtaaccactgccttgaaaacctaagcaaggaagctggagtggagtgtagagggagagagcaatagaagatgaggtcaggcaggtaactgagggggaaagcaggggagtacagatcacacagtaccttgtagttcatgtggcatttaatctgagatggaagcaattggactggagagttgggggcagctgaatgacatgctttgatttaccttttaacagattcactgtggctgctgtgtttaatggtgtgtaaagtcatttgctacaaccttttttcttttattagttgtaggaacaggtttactttatatagatcatgggaacaataaggtataagaaagaagcttggataggtctgagagaaatatatggcatattttctgtctctgcacagattttttcactgattatcagtagtttttgtctttgtgatacagagcaattgaaatcagcttgtagagtttttcttggaaaatgctttgaatatctcttctatttttcctataaccaccttagtgcatttcagattcaaatcttatggtgaacccaatatagttttagccctacctcactggttttcatgctcattaatagtttgggaatgagagtgacctggagttataatttttaaatgcttttaacaatatagtttggcatattgtaaaacaaatcatggtgtactgattagcagtgctatttgaccaataaattaaagaaaactgatagactgtgtcttaacctagatgatttatttaaaccatttgttgctgtagctcatcagctgaaatgacttaaacccccaaggtactgttactctttcccaaattgcacttaaaaaacaaactgaaattatcacttagttaaaatgtcatgatcattgtcagtaatagtatatctctgtggattcactttggtttggtagctgaaaagtttattatttttatgcttggccaaagaatatgcatcttcagtggggagcatgccatgtgtgactgaaaactgtttttatacagcttgactctgtttggaataacgcctttatttggcttaacaaattgcttttcagctttattttcacactgtaaatatcaatattgtataaacttgtcattattgggactaatcagcaaattgttttgtgtcatgagtaagcacggtctaagactgggattatttgataagtgctagaataatttggttaaactgtctatccagctctaagtaacaacacagccagttggtctgaatcactgtgcctcaacccttcactttgatgaataggtttgaatggctgaagctaatttggtttggggtagacaaagtctagtaatgtgaaactgatcatatataaaagaagtgttaacagtagtaatattacagggaatatacagggacatagagggacaattttgctagcggtttcttagttatgattttgaataccattttttttgcagttagaaactttactgtcttgttctggatgataaagacacatgtttgaagacaggtttcctatgctgaagaataacaataatttgttttccagactttctcctttttttcccttttatgtttgcttcgttaagtagtaataaagtgatctaatctgtccctgagaagtatagtagattggccaagtactttgctatacttaaatatgttaattttggtaatttagtttgagttgcgatactgttctcagtcttccctctagcttccctgtcctaaagtaggcttctcttcagtgattgctctaaacccaactttgttcctttttttaatccagactgctaaagtgatacaatgagctttatatgtgaacctggtactgtgacctgccattcataggtcattacattgaattgtgtacatatccctcgaggagaatgacttttccatgctctcacccctgttttataaaagatggtgtagtggagagaggcccaggaagaagagttgacacatcatttgatcttcactgcctctaataggtccaatctcttttattacatttgtcttctcttctacatttaaataggtttagtctttcccatcttgaacacttagaatacattaaaacctattgcaatttctttttagctaccttttgtctgctctctgtccgttcatggcagtttgttggtcctgtgactttagttcttattctgtcactgacaagggctctctcacagtgatgccttcaactatttctcagttgcagaatctagtaaatacctttttttttcttttttttttaaagacagtctcgctctgttgctaggctggggtgcagtggcatgatcatggctcaccgcagccttgacttcctgggctcaagcgatcctcccacctcaccctctcaagtagctgggactacaggtgctcaccaccgtacccggataatttttgtattttttgtagagatggggttttgcttgttgcccaggctccagtagatactttatctttccaaaattgattattgattactttctacttgttgaagttcttgtgtcattacttcttttgtttctgttttctcttagattggtcctttgtggtctccttttttttctcaggtgctcctgaatgttggtatgcttctctcagtctttatcccatttctgtactcccctctccttactttctacccttttctgccccctccacgttctgagtgctgtcagttatcacctgtatgttgatatcttttcagtccatcttcagcctgtttcctaagttccaaactttaatgtccaaatcactattgatgtttcttgaagaatattccaaaggtaccatggtcctatactatattttttgattaatttaaatttaactctaattaaaatatacatacagaaaatgcacagattataagtgtacaccttaactacacataattaacatccatgaaaccaccatccaggtcctgaaagagaacattaccagcacctcagtagtctgtttacaattcactactgtttccttcctttccaaaggtgaccactttcctgacataacaatgtagaactatatttgaacattacattaaaaaaatgtacaggatgtattcttttttctgttctttcaatatagtttgtgatattcatccatgttgttggcagcatttgtttatttttattactgtttaacattctactgtatgaatacagcacagtttatctgtttaaccacctaattatttgggtaaattttgtttgaataaaatgtattattatgaataatgctgctctgaacattttggtgtatgttttattaatatgtacttcaattgtgtatatagctaggagtggaagtgctggatcatgtggtatggacatgttcaattttagtagataacgtcaacattttcaaattggtcttgtcaatttatatttatattcctgtcagcagtgcatgtgttgttccacctttttttttttttttttttttttttgagacggagtctcgccctgtcacccaggctggagtgcaatggcacaatcttggctcactgcaacctctgcctcccaggttcaaatgattcttctgcctcagcctcctgactagctgggattacagatgcccgccaccatgcccagctaattttttgtgtgtttttagtagagacggggttttaccatgttggccaggctggtcttgaactcctgaccttgtgatccgcccgccttggcctgccaaagtgctgggattacaggtgtgagccactgcacttggctgttgttccactttttaatcaacccttaatatcagtggtcttcataattttagccattctcgaaagtctattttcttggtgactaatgaggttgaacatctttccttatgtttgttggcctttcatgtgttattcatgtattttctgtgggaaagtacctgtggaagtctttgccatctctgttgaactgtccgcctcttccttactgcaatgtaaaaagttctttatgctggatatgggccatttgttggttaaatttgttgttaatgtcttacattctgtggcttgccttttcattttcttagtgctgtcttcccagtctcttgtcttccttactatgcttctctccccaaagcaattagccatcaagtcctgacaattttatcttttaatatcttttatcttcttttctccatttctttgctcagcgccttaatacagtccttctttgctcatggcctggattatagatcacatcccttgcaatcagtttttaactgcttacagaatgacttttctaaaatttaaatcttggccgtactattcctctgcctaaaatctcccagttgtaccttagaggctacagaataaagctcaaatctcatgactggcttctaccttcttcctaggccttctttagagttgttgggtttttttttttccccagatttttactgctggataaagtctttcctgacttacttccccagttcttttttcatactcctttttgaggaaaggatgtggtagtcttaattatgattaagccataattattaagacaactagccgttcatctctcagtctcttggctgagcactactgttagcttatttgtgttggatgttttgatattggtgttccacccaactctctcattaatctgtttgcttttctggcttattctctgccagccacttaattattggtattctcaccttagctctcttcttcatacctttctccgtgagaaaactcatcaattctgatggctttaatgccattttgtatgtatatgacttctagatttttaaatccagaccagtctctgtcttaaatttcagatctctctgtattatattgtcagtgggtattgctacatgaatgttacataagtattttttattttttattttagttatgttatgttacgtcacgtcacgtcacgtcacgtcacgtcacgttacgttatgttatttttccgagatggactcttgctcttgtcacccaggctggagtgcaatggtgcgatctcggctcactacaacctctacctcccgggttcaagcgattcttctgcttcagtctcccgagtagctgggattacagatgcatgtcaccacgcctggctaatttttgtatttttaatagagacagggtttcaccatgttggccatgctggtctcaaactcctgacctcaggtgatccgcccgcctcggcctcccaaagtgctgggattacaagcgtgagccactgtgcccggctacataagcatttttaagctcagtaagccccaaactaagctcaccttcccttcccaaacctgattgtgtattttctacctttttgaacacctttttgaacctggtggggctgcctgttaaatacttctggaaaaacttaagtcaaagggtacttttgtgaaagtacctccttccccactttcctcctgttttctattactatagttctatcatggtacctacaaacattttattgtactttatctgttctccccagtagactaaaagcatctcgatactttgtccttggggaagcaagcaaatcaatgaaccaatgaatgaatgcatcttgagggttttccattgccatcctgcacagtgcctagcataaacagttgagaggtgactgagggtacctccaactaaacacatttaaaatggaactcaccagtttcctccaaattgctttcctccaaactttctgctttaaaatgacttgctgtgcacagttgatagcgtcaccatcttttcagttcacttagtcatatttaactcactttgtttttctgctactctcaaaactggttttaagcccattgctatttcttctatttcatttccttagctttggttcaagttctcatcttgtcttcaccagatcattgtaaccactgtttaaatgttttacctatctttggagttttccccgtttgtctttgatattgctacaataattatttttctccaagtgattatctcctggttctgtaaacttgcctataggataaagtccaattttaaaaaaatttattttcgttttaaagctgtatttaggtataattgatatataaaaagcaaatatttaatgtatacattttaatgagtttgagagtccaacttctttaccttcggtggcagtcttcacgaacttatctagcttctttcttttattttttttcccctcccttatagcagaagctatgtgctttaagcattggccttaccagactgcacacctaagtctatgctacttatactacctctattgccttctctccatcactcttaggaggaacatagattaaacaaaccactcttaacatttgttagctactgtccttggacaagtttctaaagatcccaaaacataatactgatgcttagtacatgttgttttcccctttcaacctttcccttcctccacaccacagttggaatttctttttcgtactgctagaaaacacttactgtttctctcacttaatgtcttctgccgaggagtcactgtgtctgtttacttgtatatatcttactgctcttgtactagatcacatgctttttcagcgcttacactgtgtcttcttgaacttattccagttgaatttttcaatcttaagggtttgctttttaaaatccacactgtatcatttaggttctaagtgatgaacatgactgggataggattttttggagtaaagtttctaaatggtcataacaaggaccagttgtaaaggcccagccagagcaggctttgtaaaaactcacctacttagctggaatttaggagagtaatacaattgtcctaaacttactctggtaggaatttaaaactataattttgatgtctttgtagtaatactaaataaaagtattagtactggaatgaattgtgtttttcttcacagccggttgctgaaccaatccccatctgtagtttctgtcttggtacaaaagaacaaaaccgagaaaagaagccagaggaactcatctcctgtgccgactgtggcaacagtggtatgtgatttccttctgtttttcttctaaaatgtgttacgaaggcaagcggaaagtatgttgacttgagtttgtatccttgatccttatgagattaatacagtcatacatcttttaattatgggggataagttctgagaaacatgtctttagaaggtttcatcatcgtgtgaacatcatcgagtgttctgacacaaaccaagagggatggcctactacacatctgggttatgtggtgtagtctgttgctcataggctcaaacccgtacagtactgaatattgtaggcagttgtaacactggtgaatatttgtgtatctaaacatatctaaatgtagaaaaggtacagtaaaaatacagtagtatgaccttacggggctacagtcatatgtggtctggttttttgttgtttgtttttgagacagagtcttcctctgtcacccaggctggagtgtagtggcgtgatcttggttcactgcaacctctgcctcctgagttcaagcaattttccagcctcagcctcccgagtaggtgggattacaggtgcctgccaccacacctggctaatttttatatttttagtagagacaaggtttcaccatattggccaggctggtctcaaactcccgacctcaggtgatctgcctgccttggcctcccaaagtgctgatattacagatgtgagccaccacacccggccatatgtgggctgtatttgattgaaacgtcattgtgtggtgcatgactgtattttaatttgattatggttttaggtgactgagatgagcttctgtactagggagggatttgaatatatagctgaaatgtgtaattcagttaatttaaatcaggtcttagtttttttttatatatataaaacactttctgtgggtttattttttcctcttggtctttacatttcagtatttaacatctgcttaaatcacagcaatcagtttgaagttattgctggtttctttaataatcgctacttcgtctttcttgatttatgcctcaggcttgatgaatagaaccaggatgataacagatttgtttttcttgatggaaacttacatatgtcacattgggaaatagtgttgatactgcagtctagcgagcaatgtgaaattctaggccctaagaaagattttgcagaatctcctaatttgccagttccagagatattcttgctctacatttcaagaactcacaagatcggccaggcgcagtggcttacgcctgtaatcccagcattttgggaggccgaggcgggcagatcacaaggtcaagagatcgagaccatcctggccaacatggtgaaaccccatcactactaaaaatacaaaaattagctgggcgtggtggttcgcacctgtagtcccagctactcaggagactgaggcaggataattgcttgaatccaggaggcagaggttgtggtgagctgagatggcgtcactgcactccagcctggcaacagagcgagactctgtcttaaattaaaacaaacaaacaaacaaaaaaaaaacttacaagaccttacaggaaggccttagcaaaccagcattatctttgaccattggcttaattttcagtgttttatagtgataacaaccatgatttagttcagaaaacagaaaccacactacatacttcaagaggaaggaagttaagtataagaattaggtatttgtgaaatcattgtcagggctgaagaagcaagctggaggttgggctttaaggactgactctggggtcactgcagaactgacccatctgaggagttactgtgtctgcctctatctggaagaggtgcaagcaggggggagtccactgcacaacagttgcgctctgtagttggtgctgaagtgctaagtttggccatcattacaatagctctagatacctacgagggagaagcatggatacggttgttaccatgactttgcttatcattagaaaatagtactaggaggaggatgatctttgctttgtttttacctttcgaatatccctggagaacacatccacttgtcagaacttagagcctagctgcaaaggagtcttaagaagtatgattttttagcttttcagtttttatgcatagtagaaggtgagaacagatcttgagtgctaggtagtcatatccagcgtgttgtcacaaaccagaatgaactctggatggatttcatagttaaatataaaccgtaaatcatgaaagattagatgaaaatataatggcatgccatacaatgcagttatttccaaattccctaattaaaacccaaatatataaaacatagaatgagttgttctaggtggggtgggaatgaaaccgaggagaggaagtgttgtgtctgcagccctgccgtctaagtagcattatatttgaggtggtctgtgcgtctctctaagctaaggatgagcataatttgaaaactattactgtagcggtaactttttttttttttttttgagacagtctcactctgttgcccaggctggagtgcagtggcgtgatctcggctcactgcaagctctgcctcccgggttcacgccattctcctgcctcagcctccggagtagctgggattacaggtgcctgccaccacgcccggctaatttttggtatttttagtagaggtggggtttcaccatctctacttcaccaggatggtctcgatctcctgacctcgtgatcctcccgccttggcctcccaaagtgttgggattacaggcgtgaaccactgtgcccagcccctgtagcggtaacttttaaagaaattgtagaacaattaactactagttatctgttgctgcagaaataaattactctaaatcttagcagcttaaagcaacaaaacattttttacttcatactgtttctgtaggtcaggaatttgggagttgcttatctgggtggttttgacttggtatctttcatgaggttgctgccaagattttaactggtgctgcagtcatctgaaggcttccacgatggctcatttacctggctggcaagttgctgctgccacgggcttgtcgacaagaagcttcagttccgtgccatgtggacatcttcacaggactgcatgcatgcctgcagcatggcagctggcctcccccgatgagtgtctgagagagagtgaggtggaatctgcagtgtgttttataacctggccttagagtcacactgtgttatttcagcaatatcttcttggttatgcagatcaacccagttcattatgagagggagttgtaagagtatgactagcaggaggcaagaatgcctagggagcagcctggagactggctgtcacaatagccaaagaagaacagcatgggcatagctggatacatgaacgttgatattttctaaattaaaaagtaacatgcttaaagtagagcaagaataatttgggggaaaataactgctttaaatatggcaaagggccaaaagctatataagtataaagaacatgtttacatttctaagcatgaagtccaaagagcagagcctgtgaactggcaatttatatgaaagaaaactaatagttgagcctatgaaaagtgttttactcaagtagtaataggaacacataccacagtagcagtgaagtatcattgtatagcgtttataataatcacaattgaaatataacagacctagagctcatgtagttgtgctaaaacacttgttcttttgctggtggcactgcatattatatcatagtttttggaaaatgttttggcagtgcatatcaagctataaaaatgtttaatacatttgactcaccaatcccactttcaggaattcattctaagggattaaaagaagtaaagaatctgtaaacatgaaataattcattttagtgttccgtagtctcagtatttaacaatagggaaatgttcatgcaggttatagtatatcagtcagtggaatatgatcagtttaaggaatataaagtttacttaaaatttaaaataaaacaaaaactgtatgtttgctaaaattacagtcatgcagagctttcagctagtttaaacaggaaagtctaacataaaaatggctattattctaggatgataggattgtgggtgaaattttcacacctcttggattttccttcagtgttagtgatgttttgataataaacttgctatctcataaaagagaaaatcctttaggaatagaaaagagaggagaagatttaacaagccctttctctcaccaaagaaaaataagcacgaccaacttttagaggagagggacagctcttttcagttgaggggaaattggctacccttaatttttgagaatcagactgataactgactcttggaagaggaagcatttttttctcttgctattcattctgagcacagtagaaatactgcttttggttttagttttagcttgcatgccttaaattgtgagcagataactcactttaagtgatggtatttttattatatacaggagtcccccttattcttggaggtttcaagacccccagtggatgcttgaaaccttggataaaaccgaactctgtatatggtgctatgtttttccctgtgcatgtgcatacatacatataataaagtttaatttataaattaggcacagtaagaggttaagaataatagataacaaaatagaacaattataacaacatgccaccatcactagttttgtgctttgggaccattatgaagtaaaataagggtgactccaacacaagcatgataataacactagcatggtgataccagcaacagtctgataacccagacaaccactaagtgactaacaaatgggtagtgtatgcagtgtgggtgatcgcagcccagctgggacagcagatctcattatgctactcagaacagtgtgcggcttaaaacttaggagttgcttgtttaatattttcacactgcagtagactgtgggtaactaaagcctcagaaagcaaaactgcggataaggggactaactgtattttttaaattacaaaagtaaaacattgtcatttaaaaaatgacagcacaaaagggtataaactgagacataaaatccttcttgatatatatagctcagttttctaggatgttatcagtgtaaacagcttttttgtatattcagtaatgcatatatgagcatttctcatatatgaacatatatgtattcatatatatacatatataccggatatgtacacacataatgctttgatgtaggcttaataaaagtttggagtttgtcaagttttttttaataatcaaattgtggggaggggtcctaacttctctttaacattaataaaactgaattgtggtgccaagtcctgatgagaaatgtgtggcaggcttcctggtgcatcttgctttatttgatatatattttgtatttaagatgattgcctttttctacatcatttctttagtactataatagcaaaatagttcttgattgtttcattcatgaatgttctccctcgtattaggccatccatcctgtttaaagttttcccctgaactaacggttcgagtgaaggccttacggtggcagtgcatcgagtgtaaaacatgcagctcctgtcgagatcaaggcaaaaatgcggtgagtatctctgccttctaatatgggtgtttcatttagtagtagaatgtacgaccagcattttcatctaagtatgactggttatttttcagacacttggtccagtagcatttagaatagccggtagtctctttaaactacatgtcattagtttagaatgcttgctaatttagacttcagttatgtctaggtaatttgtaaagcacttaattatatatttgcagagagactaagccacattaaagaaatactccccaaatttctttgagcagtacagaggcattcatttaggatggtcagttgatatattaattacaagtcgcccttttctcattattaaagcagaccagggttagcttatttctggttattggatatacttgaaactaatgaaactttagttctttatcaaagattggctggaacataactttttgctaactctatttacatagttaatacaaattaaggaaacttttaatattatggtcactcatctcttttatttatttattttttttgagaaggagtctcactctgtcgcccaggctggagtgcagtggcacgatcttggctcactgcaacctctgcctctctggttcaagcagttctcctgcctcagccttctgagtagctgggattacaggcacatgccaccatgcccgtctaatttttgtatttttagtagggacagggtttcaccatgttggtcaggctagtctcgaactcctgacctcatgatccacccgcctcgacctcccagagtgttgggattacaggcgtgagccattgcgcctggcttatctctttttttaagatccctgaagctttctaggttttatgcagtcatgatcgtaacatgtttctgcttcataaggttaagcaaaactgtcctttcttttttctaataggataacatgctcttttgtgattcatgtgaccgaggttttcacatggagtgttgtgatccgccactcacccgtatgccaaaaggtgagaaatactttctgaaataaaactgggaatataaaggaggatgttagtgaaagcacattttatctactttgttaaatgaaataataattggatctttctttttgaggttgtataagtaggaagagaactgtcaccttaaaaggtggggggatagtctttctgagtgggcatcttaacattcttacatgatacggatttattgttattttcaatatctaggcatccatcaatggtgaagtggttcatttatacatatttgccagtctctagctagaagataaaatacttgccttaaatatatcttgaaatatctctttattgaaaggaggaaataaaatagtattaggtcgtgttgattatatcactgcttagcacttttgagggccctagagctatagagatatggtttattcaaaacttaaaaaaaaaacctttttatgaaatactttatgaaataaaaaggttttttgttgttgttgttgttgttttaatgaaatacattctgaacaaataagtgtccagattgtaagggcgcagcttaatgttactcttttcttttgattcctgttcattgagaggtatttagtttgggcatagttgcctcatggttggacttccatattcatatgcttataggttctttaaaaaaaacttcagccagacccctctttttgtcctatcacaaattccattttaactctgattttataatttataggcttcttaagtaaaatgcctataggatatttcataatatttgtttggaaaaaaatttcctgttgatagaaaatgacttaaccgtactttgtagtcatgttaacactttaggtttttacttgaattcacttattccaccccctcacccatggagtctcactctgtcgcccaggatcttggctcactgcagcctccacctatcaggttcaaagcgattctctgcctcagcctcccatgtagctgggactacaggcgtaccacgacacctggctaatttttgtatttttagtagagatggggttttgccatgttggccaggctcgtcttgaactcctggcctcaagtgatctgttcgcctcggcctcccaaagtgctgggattacaggcatgagccaccgcgcccagcctgaattcacttactgattgttactttttgaaacgtcttcaatttataaatactaaagaataaatacccactttttccatttatgtgaagtctgagcaaggggccttctaagagtcctaagaaaggttttttttttggagttggaatctcactctgttgcccaggctggagcccaccttggcctcccaaagtgttgggattacaggcgtgagccaccatgcctggcttgcagctaatgttttttgtagagatgcagtttcaccatgttggccaggcttgtctcaaactcctgacctcaggtaatccgcccacctcagccccccaaagtgatgggattacaggcatgagccactgtgcccagtcaagaaacatttccttaggactcctttcttgtgtgtttaacttctacaaaagagattatatagcagctttaggcaggaaactttttttttgagacggagtctcactctgtcgcccaggctggaatgcagtggtgcaatctcggctcactgcaacctccgcctcctgggttcaaacgattctcctgccttagcctcccgagtagctgggactacaggcacgtaccaccatgcccagctaatttttgtatttttagtagagacagggtttcaccatgttggccaggctggtcttaaactcctgacctcaggtgatccacccgcctcagcctcagtggacttcaagtgcagtcagtggacttccagtgcaggcttgaaggtgtatgtgagtctcttccaattatttgtagaattttgtgtgtatatgttttaatgtttattttggattggagggggtattcatcagattttctaatgacagtcttttacctgaaaaagttaagatcctgacttaagactatctgaaacctttcagtgtatttatgtctgtcacacttctatgtggaattttatttttttataggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtgtaagttgtacttgtggcaaggtgaggggagaaaaggatagggtcttctctatagtgtaggattcacttgttttctctatgaaaaaaattccattgtcatatctggcacttttatataataataatggctaacacttattcagcccttaataagtgccagacactattctaagtgctttatatgcattgaattgtttaattctgccaacaacccagtgaaatatagctgctgctgttactttcatttttcaaaggaagaaactaaggcatagtaaatgttgaactgggatgaaaatccgagtagtctggcaccaaagtctgactcttaaccattgctttatgttgcttctcttatataaaaacaggaaagaaaaagttgttactgtgacatttcacatgtcactctcctgatcttgtctcagttgttaatatctattaggtgtacaaatcactggataggttcttcctattgaggtgatggctaagtcccatttttgtgttctttggatgtaaaataatttgaatgttttcatctattagcagaaatcagaaattgtggactagaaagctgggctatgtctggaggaggtggggcaagattcagtagctagttttgtctttttaaaaatgtctgtagtaactcacctttgatgatatgtaaacgtcttcaggcttgtcaacctccctttattatcaaaagttttacttactttttttacacgtaagactatcttgaaggtgatataactgaaatgaatgggcattagcagcctgaaatgtacagaaccaatattgtagtctatattcaaaatcttaaatcaagctttgattttcctataaaatgatcttttgattcctggccttcgaagaataacccatccttgtgttttagagataaaagtataactttcagttggtgcagagatcacagtgtagtagaactttatacctggaaggatcttagttgttcttagtccagttctcattttacagatgaaggcactgacatatgtttagaaaaaatgtgatttgtccaagtcgtacagctagtaagagagaattatgactagaacaagtcttctgactcctggcctgtcattctttgcactataagtaggcttcctggcaatagatgtttctaataataatattaattttcattcacagagtactatttatagtttgcagaatattcttaataatatagattttaataaagctgtaggttacttactaattatatgttatgtattaaaaaggaaccttacaagtatcttttttaatacttaccctttcccctgtttaattgtttagatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacaggtaagagtttagaacagacttagaaacaaatagtattctgtacatgtattattcgggataacactaattatctataatggatttatatttgattattaacaattggttatagaatataagaacacattgaaaaaacatgtagatgatactgaggtgataactgtggcaggaatttagaggatggaaataaagttgcagaatgggacagtaggaactcttaggcaaaaggaagctgcttttttgtagaaccacaaagaatctgcctagagaaacttggggtgtaaccttgaggattactttacatttcacaaattactaaagaaatcatatggtgaatgttatgatgcctgcttattccaggaaggaaactggaaagaatagaactgggtgaaatgctgttgatctaagcataaaaaaaagaccaaaatatttgcagatgtgatgaggtcattgacttttctacttcagatcttgacaaatatagttgtaagtcatggattgcacttaaaaagggagagacagaaccacagctccaggctgcttatgtatcaggctaagttccctaattttcaaagtagaaaacatctgtggagaggacttaataatgtggcaaatcattcaagtcagaggagaagaatttgattaactgtccaataaattaaagcttaaaatagtcttattgctgagccttgaatttagagatactaaccctgtgaaggaagtagaaagggcttgaagaaagtagaatgagaatgaactcttttggaccacaagggccagaggtgtagtgtctcatctactacaagagaattccctgaccttggtttcctccctgaatgtctccttggtgagggagagtgtattcactgctctcattcgtggttgattgtccagtgcaggagagaaagtccttgtaattgtcagagtcccctttgtatgctttattgattggtcttttaccatagtgatgatcaactaattactctttaagcattcaagactcttcatgtctttatcaacctgtagataagttcctgatctgagcatgtttatctaagaaaatatgcaatccgtttagattaaactaggaaagaatctcagagcaaatcctaatgaaagacatttttgaattaaccatttgtactggagacggtttattagaagaatctactagaaagcttttgaaatagaaattgttagagcaagtgtatcaagtatatggagaaccaatattgaatttttgacagtggtgtgagcgtttgctttaataggctctgtcattttctttatgaattataaagtttaagtaccgaatgctgtattagagaggtgcatgcatcatgcactagggggcattaaagtcacatagtacctttagattgtacttttttcttccagtttgagaatgttgtcaacagtgagtccttgacttttttcttcttgtgttaagttaataacagatggcccatatgtgcagttgacttgagaactgtcaccaattggtcttttcagccatacttataaagagagcaaatgagcccaacagcagtgtcatcttcaaatgcaaaggataatgatcttcataagtcccaaatactctcttcactagttttttgccaacttgaggaagttccatcatttagtagataattatcatacgttttcatatttacccagatgattatcatctgggtaaatagagtttgtgctttaaaaggacagtgttttaaagtttgtgctttaactttaaaagggcacccagaatgtgatgggagttagtactgctgacatcagttaaggtagctactcaagaggtttttttgaacgttgatgcattaaacctatactaaaagtgtcaaatttatactatttcaaaatgaaatttatattccttatatcatttttctgtctgcctttctgtgtattaaaatgtaatctttaatgaagtttaaatttagttatataatatttttaggaagctttaagacaattcaggatttccactataaggcagatttaatacataaatattatttattgagtagcattcttctaagagtcagtttaatgctatattcttcgttatatattaagttcttcaaattgaaataaagacctgaaattttttctagttcatgtattaatctggggacagttaacatgtgagctctttttttatatgtagacaatcaggatggctgggatggcaaacaagaaaatgaggagcgactttttgggagccaggaaatcatgactgagaaagatatggaattatttcgtgatatccaagaacaagcactgcaggtaaagttggatattcaggttagacaatcaagcaacttgttcatggctgagaaacagcagattaattacattgtgggttaagcagtaacagcagtttgcctaatctcagaatagttgtggtttgtgtgtatatgtagttctgctgtttataatattcctttcaaacccatgataactgctttggttttgcagataagcacatggctttgactatcaatattaaataagcttggtttattttttgtcttactgtatgaagaagaatttgggatttgaccaaaaacaaacaaaaaacaagcttctcatgagtgataaaacacctatatttattaattcaagaagtatttcatgcctgtaatcctagcactttgccaaggtgggtggattgcttgagtctgggagtttgagaccagctggggcaaaatggcaaaaccccatctcaaaaaaaaaatagaaaaattagccaggtatgttggtgcacacctgtagtcacagctatttaggaggctgaggcaggagaattgcttgagctggggaaatggaggttgcagtgacctgagatcatgccactgtactccagcctgggtgacagagtgagaccctgtcttccaaaaaaaaaaaaattgcaattctttgtgacacatggcaagatcgtaaatatatagacagagtctatgtgccacatgctggagatgccagtgaatgactgaattctttccctgaactataggagagatttgtgaataagtaatgtcattaatatgaaaagttcaattatagaatacttgatgttttgggagaatagggaagccagcttctacttctgcctggggaggtcagaggaggattcattgaggggccttaaaggatatgtaggagttgtacatatcccttaaagggatatgtagggagttggttcttatataatcagaaggaacagaagtgaaggtggaatagacttgaagataggggaaaacatgcttaattgtgggaattaaaatggctcaggataaagaatatagggtgtggagaatggcaggaggtgaggttggaaaagtgcaggggctagatcataaaggctcttccagattatgttcatttattttttgtcttttccttctttgccaccaacaaatgtaccatgtaagccaagttctcttttatcttgaaaagaagaatttctaggctgggcacggtggctcacccctgtaatcccagcacattgggaggccgaggcgggtggatcacttgaggtcaggaattcgagaccagcctggccagcatggtgaaaccccgtctctactaaaaatacaaaaattagccggtggcacacgcctgtggtcccagctactcgggaggctgaggcagaagaatcacttgaatccgggaggtggaggttgcagtgagccgagatcgtgccacaccactccagcctgggcaacagagtgagactccatctcaaaaaaaaaaaaaaattctaaggctgatgccgagggttctagggaaaactcttcatattaagagacccagtggtggtgaatagactgttgatgtcggtcattatgtgagtacttttggaaaaataaaacagcagtacaaatactcagcacgcatttactcagcattctgctgtattatgatttaacaaaatattggctttgattcaggtggatctgggttcaagtcttgatctgtcatttactaacttctcctttgggcaggttgccctcaaagcttgtttcctttcatgctagtgagttattataggtactctagtagaaatctacatggacttcagtgggaactgaaaggaggcagtagttatgttcttcctgactgaaagaatttttttttctcctcccgagtaagttgcagacataatgtgttaatatccctttactcctaattttttgtgtgtatttcctaaaaacagaaatgttctcatacatgaccatggtccaatcatcaaatcaggaatttaacacaaattaagtactattatctaatttagttgtcacgtctctctagtctccttccaattgggaacagttcctcagtctttatctttcatgaccttgacagttttgaagtgcacaggtcatttatagaatgtcatcactttgagcttgttttatttttcatgattagaaaattccacaggtgtgctgtgtcctcctcagtgtgtcacatcagaaggcatgtaatatccaagttctcatcacaagtgctgctaacagtgaccacctggtttaggtggtatccatgtttcttctctaacattgctttctacctataattaagtatcttggggggacatactttgagacagaaatgcagataacctgtttttcatcaaacttttatctaccacatttagcatccagagatgatttttgcctgaatcatttactttgttggtggccaaacattattttctaattctatcatttctttgccatttattaattggcattctattgtaaggagaagctttttcttcttcctatttgtttattcattttgtttaaactcatagattattttatggttataatccattgctattagtatttattttgatgcttaaattgttccaaatttaggcagaggggaactcctttctagaagctcctctgtccttttaacacatcatcatcatttttatttacttctggccacagcaagatgttctaggctcttactgttgtagccatagattctggcttttagtggtgaacaagagtaaatggtagctctatcctgtacttgcttaggcccacagagatgtcatcttgattttttttttctctgtcatacttcacattcagtccatcagcaaatcctaatggttctgccttcagaatatgtctgtatttgctactgccaacccactgtcatctctggcttaggctgctataattgcctccagactaaacttgcttctgcttttgccaccaccccactctctagtctattttcttcatacagcggccagggtaattatttttgaacgtaggttggattataccacttccttgcttagaaaacctttcatgtcttacagtcttctttagaattaaaaaaaaaaaaaaagagtctgttctctcatctccaaggctgtatatgattttgtgcctgcctccctctttggctgctctttttgctctcaggctactccagccacagccgcctcctcttcctcagacacaccaagcatgcctgccttgggcctttgcagtcgctgcaccttgcctcgatggcccttcctctagagtcgatgatttagtaggttcactgcccattccatttaggtcttgctcatatccacacgaaaatagcttacagcccattgtgtcactctatcccctgacctgcctgctttttctgcatagtacctaccacctcttgaatttaaattttttatttctagaatgtaagtgccttgagaacgaggcctttctttttttttttttttttaaattataccttaagttttagggtacatgtgcacaacgtgcaggtttgttacgtatatgtatacatgtgccatgttggtgtgctgcacccattaactcgtcatttacattagatatatctcctaatgctatccctcccccctcctcccaccccacaacaggccccggtgtgtgatgttccccttcctgtgtccatgtgttctcattgttcagttcccacctatgagtgagaacatgcggtgtttggtttttttgtccttacaataatttgctgagaatgatgatttccagcttcatccatgtccctacaaagaacataaactcatccttttttatggctgcatagtattccctggtgtatatgtgccacattttcttaatccagtctatcatttctggacatttgggttggttccaagtctttgctattgtgaatagtgccgcaataaacatacatgtgcatgtgtctttatagcagcatgatttataatcctttgggtatacacccagtaatgggatgactgggtcaaatggtatttctagttctagatccttgcggattcgccacactgtcttccatgattcttgaactagtttgcagtcccaccaacagtgtaaaagtgagaacgaggcctttctttttggtcactgctatctactgagtacttggaatatagtaaaggctcagtaaatatttgtttaatgaatggatattgaatgaaattttcttctgggagaaatggggcaggagttgaaataatagaaaggtgcaagaaggatgaccaaagagagttaaacgggttgctgagccctgctgaggctcggggagacagtgtaaatgcttattgacagtaatcgggctaatcctatgtttctttccagcatttgattaaactcagcattgtctgtgtgtgtattggcaccaaggaaataaacagctagatcttggaagtctagttcatgcttatttttgttggcagtgcactgaaattctgatgatggtgctatttctccatgaggcttattcatttagcatcatgcacctgccttggtaccagaactatagggcaaacaaaaagacacagactctgccttcatgaagcttttagtttcacaaacagacagataataaacactcataaaaataaaactgtacttacaaactgatagtcggaaggaaatgagaatgcagtgaggggttctgacgggctgggctaccttgctgagggttggggttggagtgtttatgagaagggaagacttttgaagaagtaacaatttatacatagttccaaaagagtattcaaaagtcagcagagtaaagagctagagaagaacatttcagagacaagtggattgcctatgtaaacgtctaagggtgtgaaagaggttgataaacttaaggaactgaagttcagtgtaactcaaatacagtgaacagaagagttgcataaggtgaagctggggaaatagactgaggccagaagttagaattggggtttttatcataattgcagtgggaagacattgaatggtttttagcaaggaaacagcaagatctgtttcattaaaaaatggtttttcttggctactacataaagagtggtttagaattaagcaagagtggaagctgggaaaccactttgcaggcttttccggtgatcaggatgagagaagatgttagctaggactagaggggtggtggtagaaatgggagagaagtggatggatttagatatattttggagttggaatcagcagaacttagtgatgagttttatgtgtagcttgaggaagcaagagatgatcaaagatgacttccaggttctctgacttaatttaataaagaaagtggtttgaagccacttgggaaagttcatgttgactagataagaggacattttgaataatgaaaggattcataaatatagtgcagaaagtcatttttgagagcatagatatagcttagatgatgcttgaacctgtgtttcaaaaattttgcaggtagattttattacagtgtctttggtagtcttacagcagcatcagcaaaagacatgataaaggaattaatattagaatccatccaactaataacacattgtttattgagtgcctgctatgttctagaaactatggtacggggaggggctatcagaaggacatagtttctgttctcttagagcttatagtctggaagggactatcttgaataatcaaactttgcatggaacattatctaagtcaaagataattgaaatatttagcaagatttttttcaaaaggagtcagccacttattggttttaatttttttaaaaaattattgcaggcagtagggtaagtatggatgtagtttgcctagtactgtgttccatcattagctatacaacatacacttccatgaaaaagagccacctctgaatacaaaagtggaagcataaaaaaattagtagtataggtttttgttctagaattttatttcaactatgatcttacgagcttggagaaactatttttcttaaaagactctgtcagtagaaagaagcatttgtgtgcatgtgtctttatagcagcatgatttatagtcctttgggtatatacccagtaatgggatggctgggtcaaatggtatttctagctctagatccctgaggaatcgccacactgacttccacagtggttgaactagtttacagtcccaccaacagtgtaaaagtgttcctatttctccacatcctctccagcacctgttgtttcctgactttttaatgattgccattctaactggtgtgagatgatatctcactgtggttttgatttgcatttctctgatggccagtgatggtgagcattttttcatgtgttttttggctgcataaatgtcttcttttgagaagtgtctgttcatgtcctttgcccactttttcatggggttgtttgtttttttcttgtaaatttgtttgagttcattgtagattctgtatattagccctttgtcagaagagtaggttgcaaaaattttgtcccattttgtgggttgcctgttcactctgatggtagtttcttttgctgtgcagaagctctttagtttaattagatcccatttgtcaattttggcttttgttgccgttgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatgggtagccagttttcccagcaccatttattaaatagggaatcctttccccattgcttgtttttctcaggtttgtcaaagatcagatagttgtagatatgcgacgttatttctgagggctctgttctgttccattgatctatatctctgtcacatgcacacgtatgtttattgtggcactattcacaatagcaaagacttggaaccaacccaaatgtccaacaatgatagaccgggttaagaaaatgcggcacatatacaccatggaatactatgtagccataaaaaatgatgagttcatgtcctttgtagggacatggatgaaattggaaatcatcattctcagtaaactatcgcaagaacaaaaaaccaaacactgcatattctcactcataggtgggaattgaacagtgagaacacatggacacaggaaggggaacatcacactctgaggactgttgtggggtggggggagggaggagggatagcattgggagatatacctaatgctagatgacgagttagtgggtgcagcgcaccagcatgtcacatgtatacatatgtaactaacctgcacattgtgcacatgtaccctaaaacttaaagtataataaaaataaataaataaataaataaataaataaatttttttttttaaaaaaagaaagacgcgtttgtattcagttcattccagtggagcatgaccaccttcttgaaatatatagaatgatttttacataaaatatcaaagagcacattgtattttcatacagattttaatgctttctgattctgaaggattcctttggtttttgtatggttctggaaagttacagagcatttttgaaatctgtgcgggttattaaaatttctttgcgtgaagagttaaatcattattaaaaatacagtaagctagtttcaacaactttattaaccccatgatgtagaggtgttaccccattttacatatgaggaaaccaacactattagttcagtgacttcctgtaagtttttatgttagtggagccgaaattaaaacttaggccatgtgacttctaattctgtacccttaatcacaataacatcctgcattattctgtatacgggatgtcatgggggtagcaaaatcattaggcatgtgctaagtgcaggcaggtaaaggtgcataggaagatacacagcagacaatagcttagagtaccaatgaaacatagtgcattgctgtattaaatgattcagacttgtctcagatgttcacagtatactaagatgtgtgagaattggcgcaacctgagatgatcacagaagcagcagtcctaaggaatgatgaggatttaggtagatggagagaactagggcttatcagatggagtaaacaacattaacttcagctttgaggaagcaatgactactatacaggagtccccgcgtatccaccagtgatacgctccaagatccccagtagatgcctgaaaccgtggactgtactgaaccctgtatgtactgtattgtgttacatgaatgtagtctgtctctctctaaatctcttattgtactattgtactgtactaactcttctgacggtgtgagatgataaaatttgcaccgaggctgacgacaggtaactagaacctcgaaaagcaaagctggggataaggggagactactataaataattccagctggagggcaaagacgtattatctgtgtattccaagaacctgccactgagatagcaagcagaagctcacatttatttggcactcactgcatgaatggcatagtgctgtaagttctgtgcaaatatcaactcgtttaagcttttcaacaaatctgatagtgacttgcccaactaaggtgattcagccgagataggatttgaactgtgctagccttttctagttcccaggctcttaactactattttaataagttgtgctaaattatccaatgaactaaaaatacatctatgcggcctttaatatgtgacttatatttaatgggtaaatgccttaacacagtaaacatcgccccacctaccattcctactttcagcagcatcaaggagacatcacttaacagcaaaaagatgtcatgggggtaccttaaaatcccgtcatgccgaaactgacatcttgttactagctttcaaaatgctccaaaatgcagcttaatactagtaattcagtgtattaccattgcccaacagatgttccaccctgtcttatctcaaactaaactccagctattcctcactttgcatggtgcaatgttaactgaaacccatgcttatcaaactaaagtagattgaaggaacaggagatgatcaaagatgacttccaggttctctgacgctgtaataaaaaaagtggtttgaagccagttgggaaagttcatcttggctagataagaggatgttttgaataataaaaagactcataaaggtaatgcagaaagtcatttttgagggcatagatacagcttagaaactgcttcacctgtgttagggttggcaaaatatggcctgtggcccagtcccatccacagcctgttttgtatgacctgcaagctgaggatggttttaatatttttaaacagttggacaaaaataaaaagaataatatttatggacatgtgaaaattatgtgaaaaatgttagcgttcgtaaataaagttttattacaacatacaaaaaacccatgcatatcagaactaaggtcaaatctgtcacctcagaagcacggacacaattctgatgtgtacctgtttccattaacacagtgccatcaaaaacaaggactgcctgtcttacaacacctttatgggcagatactgtgttttctatatcatctccacagtgtgacttgcatgtagtaggtcctcaaatatttgttgatctgatgggccaataatcaccctatctcctgtatttacagtaatcccccttttatctgtggttttgctttccatggtttcagttacccttggcttgccaaggtctgaattttattatcatcgtctcctcctcctcatcatcatcagaagggtgcataccatgcaataggatattttgagagagaccacattcacgtaactgttattacagtacatcgttttaattgttctgtttttagttattgttgttaatctcttactgtgcctaatttataaattaaatatcatgggtatggatgaataggaaaaaacatagtatatacaggttgactatcccttatccaaaatgcttgggaccagaagtgttttggattttgattttttttttttttttttttcagattttggaatatttgcatcatatgcttagccgtcgagcatcctgaattcaaaatctgcagtgttcttacgagcatttcgtttgagtatcattagtgctcaaaacgtttcagattttggagcatttcaggtttcagattttcagattagggatactcaacttgtataacatttaatactatctgcagttttcaggtattcactgtaggttttggaaaggtgtattcccagtgggtggataagggggactattgaataaacaagtaattaaagccatgtggttagtaatagataccctcttattatatgtaaaatactatattcagcattatatattaatttgtttcatttaatacaactttattattaattacttggcctcatcttacaaatgaagaaatggaaacattagaaggattgttttacctagagttataaattgttaagtttcagagtcaatatttgaaccctggtattctgactccatggccttaactgcttaatttatgatatagtattactgtggagatatgcataaattgcagtgagaatgaacaggaagacatctagggatgttattgttctatttttagttattgtggttaactaaaattttaagtctttgtagaggaggtgacatttgtgtagggtgctgaagggatgagtaagtttactattggagaagagtgagaaggcatttctagtagcaagtttgggtgtgagaaatcgtgtattctcggagctgtgtgcagttggttggagttcaaacaagagatgatattggaggggtactagatcatgaagattttgtgtttcatattaaggagtttgtacttaatcttgcaggtaaagtagctctttaaagtagttaagtagtagctaaatagctcttgaggaactgctaaagaatttctaaaaagtggatgacatcatatttgtattttagaaactcaagtctggtgatattgtcagcaatggattgaggaacacctgagcaagggaccagtcagatgattacagtagtcaaaatgaaaagtgactggggcctaaatgaaggtagaagagatagataggagacagagatagataatcgttttgagaaagacttaagatagaatggaaaagactgctgttggattgggagttaggattgaaggagagggcagaaccaagtaggtcttctagtgttctatttggagtagatgatggtattacatgtaggaatataggaaaagaagcttatttagatggaagaagagaccatgcttacacagttgtgggattgtgtgaaatctaaagtggagaactttggtagatggttgtgtacatgtatatacaggagaccttgggtgggagatttgctgtgttaccagcacatgtgattgtttaaaatttttatcaaagataatatttatctaataataaatattactaaatactggctaccatgttccaagcactagagatttagcagtgaacaaaacattaaataaaaaatgtcttcctcttgggagcttacagtttagtttgggttggaatgggttaaaataaatggtatgccatgtggtagtgttatggagaaaaagcaggggaggaagagggagaattcagagggagaggattaatgtatgcagtattaaattggtcaggtggggactgtctctctgacatttagcaaaaacttgaaggaggtgaggggatgaaacatgtaggtaacgggggaatagcattccaggcataggaacaggaaatgcaaagacccgagtcacaatttgtgcttggcatgatcaaggaagtacaaggaggccagtgtgactagagccaaatacataaggctcaaaatagcagatgacaaggacagaagggtaatggaaggctggcttttgtagggtcttcttggccattgtaaggactttgacttttactctgaatgagatgggaaccctgggagggttttgagcagaagaatgactttggttttaacaggatttctctggctcctgtgtagattgagggggcggggggcagtatacaagcagggagaactttgggaaactcttgaaattattgaagtaagagacatggtgtttggatcatggtggtagtggtggaattggaattctgagtatgttttgaaggtagacccattgggatatgttgatgcattgtgaaagcagggagtccgagacgatgccagaacacagttggaagacggagttgccatctactgagatggggaaataggaagagcacatttggggaaaagatttaggagtttgattttggatgtgttaaacctgatgtgagaggggatatcaagtagatagtgggatatgtgtctctggagttcaaagaacaggtctgggctgaaattttcaattcaggactcaccagcaagtaggttgtttttttgaaaaatgagactagatgagatcaccaagggagaagagaagaactttgagtctaggttattccaacttttagagattggagaaactgagaaggaatggccagtgaagtaggaaaaaaaacatgaaggtgtagttccttagaagctaagtgaagaatgtgttgtaagaaggaaggatcagtttttaaattctgcaaataggccaagtaagaagagaactgaaaattgactgtccagcttagcaacaaggaagtaatcttgagaaactgtttccatgatggggacaggggagggtgaagagataattggagtggtttcaagaaagaatggaaggagaaattggttatagtagtaatatgtggccattgttttgaggttttttacagtaattaggagcagagaaagggagagttggatagagctgtgagggctaaagaagatacttttttttttttttttttttttgagatggagtctcgctctgtcaccaggctggagtgcagtggcaccatctcggctcattgcaaccgccacgtcccgggttcaagggattctcctgcctcagcctcccgagtagctggtactacaggtgtgcgccaccactcccaactaatttttctatttttagtagggacagggtttcaccatgttggccaggatggtctcgatctcttgaccttgtgacccgcccaccttggcctcccaaagtgttaggattacaggggtgagccaccatgcccacacacccctctccccctttttaaaatatggaatgaataacagctgtttgtatgctgatggaatgctctggtagagggaaagctgatgatgcagaagataggaggggaactgctgggtgatgttctttggctagggagcaggaagatgttatctcatgcacaaacggaagccgtgggcttaggagctcaatctttagccatagtattggtgaaaggcaggatgtgtggcacaaaggtggaggcagacagatgtgggtgggaaaaattgcagaagttttcttttgattttgtccagtttagtgcagtaggaagcaaaagcattggctgaaagtgaaggtggagtaagcagtgttggaggcttgagcagaggagaaagggtgcagttgtctttcagaacgggagagtgaatggagtaggaagcatcaggacctgcttgaggtttgtgggtaggtgtataatgtgagactgggtagcatgattctctgtttttctccacccatattcacattaaggtaataacttcgattatgtgaagagttgaatttaacaggggttaggattttgttgtgaaattagaagagaaactagagagttaaaggtctatgcaaagggtggaattacagggaaaaagaccttagaatctaagctgcgtagagagaaaggagggtgtggggagagtggaaagctgatggaagcactggattatgggtcctccggatggaaaaggtaagatggccgaggacagaattctagattttgtcaatatttaatggtaaaagaattagcaaaggagatggataaagagaagtctgagtgtagagcaaaaaggcttaggaaaagggaaagataggtcacaatatccagaatcctgaaatttaaggagtcctgaaaatttgaaaaaaaataattgtggtaaaatatacataatgtaaaagttattttaaccagacttttttttttttttttttttgagacggagtcttactctgtcacccaggctggagtacagcggcgtcatcttggctcactgcaagctccgcctcccgggttctcgccattctttgtatttttagtagagacggggtttcaccttgctagccaggatggtctcgatcgtgatccgccggccttggcctcccaaagtgctgggattacaggcatgagccactgcgcccggcctaaccagaccatttttaagtgtacaattcagtggcattaaagacattcaccttgttgtgcaatcatcaccatcatctatttccagaacttttttatcttgcaaaactggaactctgtacccattaaacaactcccaaccccccacccctacccccacccctggtaagcatcattctgtcttctgcctttattaatttgtctactctaggtaccataagtagaattatacaatatttgtccttttgtgtctggctgtttcacttagcataatgtccccaaggttcatatgtattttagcctgtgtcagaattgccttccttgtattttttttttttttctttaaagacagagtcttgcactgttgcccaggctggagtgcagttgcgcgatcttggctcactgcaacctctgcctcccgggttcaagtgtttcttctgcctcagcctcccgagtagctgggactacaggcatgtgccatacacccagctaattattgtatttttagtagagacggggtttcaccacgttggccaggatggtctcaatctcttgacctcatgatctgcccaccttggcctcccagagtgctgggattacaggcgtgagccaccagcgcccaaccattgccttcctttttaaggctggagaatattccattgtacgtatgtaccacatttggtttatccattcatctgtcagtggatacttgggttgtaaatagtgctgctatgaacatgagtatgcaaatagatacccatatacaaagaactgctttcagttctgtggggtctataatcagcagtggaattgctagattatgtggtaattctgtttacttttttgaggaaccatcatactgttttccacagcagctgtgccattttgtattcccgccagcaatgggacaagggttctgatttttccacatcttcaccaacatctgttattttctggtgttttgcatttaaaaataataaccatcctaatgggtgtgaagtagtatctgattgtggtttgatttacattttcctaattattagtgatgttgagcatcttttcatgagcttattggccatctgtatatcttctttggagaatggaaagaaacttttccaactttttttttttttttttttttcgagacagtctggctctgtcacccaggctggagtgcagtggcgcgatctgggctcattgcaagctctgcctcctgggttcaccccattctcctgcctcagcctctgagtagctgggactacaggtgcccgccaccaagctcctcagctaattttttgtatttttagtagagatggggtttcaccttgttagccaggatggtctcgatctcctgacctcgtgatccgcccacctcagcctcccagagtgctgggattacaggcgtgagccaccacgcccggccttttctaactcattttgcaataaagtcccacttgacctgaactgagttactgacaaaaacatgatctgagctgatgtgagactatttgtattccttacttatgccagttaatgtgaatattcatatgctttgctaaagaaattttagtgtgtctgattatggagtgctgctccaaatcctactagggctatacacatgcatgtactatacacatatatgtactaatacttttctaaaatcagaaaaattcagaattccaaaacacattctactccagtccaagggttttgggttaaaagtttgtggacttgtagcttcatttctttggaaaaccaagttcccgtttttaaaaacttacccataaactttgggaatttagggaggaattagttgagggctgtcgttacttccgtcacatctcaacccatgtcattcttttctgtctttatgcttcactcgctgttcctgcccggtgcttttgcctcttaacctgaggcttatctgaggcttattttttcatctgcagagtgggtatattgttttctactttgaaggatggattgtggggaccaaaggaggtaacgacataaggctcaggtcagagtctagcacaataggtgctccacgaacatgattttctctagtccttaaattcatgctctctctgttgtggagcatgtgaattcattctttcatacctctttcatcatgtaacttttaatccctaatgaatggaattacttactgtagtgtttctgtgggaaaatgttcaaatgccagaaagccatctcttctccccacattcccagcctcacactgataataaaggggtacctccctctctcctcaaaacattgcacccccttggggaatggagagggaagggcaagtgagagcgctccagtggacagatgggggaaggcagcagctctgtgtttacagaaattgttaaattatttacacaattttggtgtccctaccagatccagagttggggatactgcaagaatggccttttttatgttacaaactggaattagatgagtcatttaattgaagcttaagtttttgtagaagagtaatactcttttcatataaactggtggtaataaaagctttattatctagcagtaggcataaagttttcttttggtttagcccaattattagtgtatttaatccacccccttgctaccccctgttagttatcttagattaaaaggtcaattctagcctggaacatacgtcttcttttaaataatttggcatatttaaattaggaggacatgaagtggcagaatttgagttaaacatttaaatatattttgtgcccttgattatattagacacctgctgctttggaaagtcacatgtttagcgaaaacgtactttggttgaaatgttaaaataaaaagacctagcaaaggtaaccttgtagttcagatatgacagtttgattttggctaggactggaatgagtggtttctgtgtagccatttcttcctccctgtgtagagagccttgctgatttctaaatcttcgtaaaaggaaacacccttgctgtggaggcttgctcaggggagctgggagtggaggcgggctcacacatgagcgcatgtgcaggaacgtttcacggtgcaaaggttaaaggcgggtgtgggcagaggggaacctaccacaggtcccattctggacagacgtgcgcagttgtggtgatgtgcaaacagctgtactggaactggatatccactttcacatcgggcatccgcctagaagagcagcgggcagctgatgggaagaccctcaaacaacagacagtgccgcagcaggtgcatgacttcagcttttgggctttctatctgatccttgcctcaggaagttagatctggtttctggtatttagttattttgaaagtttcctatactgttgttattactttgagttgtgaagatagatgaaaagatagtactttatgagttagagtagttgattctagaatgtagtttaaaaacagcctttaaaaaatctttttacaaagttctgtttgggttttgagaaatgaaagaaatcttattttaaccctgtattatgtattcttcattgtttttggttttgtatttggaggagccccagtacttggtggtgttataacacaattcatcccacaaacagatctttgtcttttgttttgaggtgtctaaggaagagcttgaggtttcatttggctacattccagtatgaaacctgagataagtcccttggccttttataaaagagaatggttagaaagaccagaaggtctctaatgagttatggtgaagaggcttctttaaacggatttatataaaaccaatgaataaaaatttcttttagttttgttataaaatatgtatgtgtgtctgcatgctccaacaagggatttttactagtctcttagtggtctttaaagcataaaattgaaggataatttcagttatccttttggggaagagttattaatgcttgtttttggttaggctaaactcttttgtctttttcttgtcagttagtatttgtagagcatccatgatatatctgcactcacacacatggacatgagtgtgtatatgcatctgttgctagactgggtgcagagcaagtcatgttgcccttgagttaacatgttaagacccttaacagcctttattttcttgagctacgtacttatgtttgaatttctgatctggaaagtcagggaagtcataaaggctttaaaaattattctctgtttagataatgtagttcagactattgcagggatgaggggtatagagattgttttcattgtaaagagaaggcagaaaaaagagaaggtctgtatataacagagtgtctttctttggttaaatctatgcagagctactaatgaagggaattttaggcatagtatgaaatgaagactctcttgatacttgttttgtcagattctttttgtatttctcttaaatatctactttcccaaactaaaaaatcatcctttgtgtgcttacatattcagtagggcatctccattgttgtcagcggaggcagtgtggtaggacttcagcaaatatgcagtgtccccctccctcacttgtaaattattctttatcttatatcaccaagtatcagcagtttctctttaatattaagtcattaagagtgagtttaattgaggaaaatatttttactgttattaaatgtagaaatgcagcaacacccaatgcatttggttctaagagatttattagcatttttatttttcatctgggtgctctgtttaaggaataatataacttatttcaaaatatgttagcttgttctggcttttgtttttgttttactcctttggagtcctgagaagacaacatttagattcagaactttctttgttatctcagtgtgtctaatttagctaacttttgaatgtatttcttgactgcacagaaagttggagtgactggtccccctgatccacaagtccgctgtccctctgtcattgagtttgggaagtatgaaattcacacctggtactcctccccatatcctcaagaatactcaaggtatgttttgagagacccttgaccttctgttttgagatccatagaagtctggaactggaagggatcttgaagatgtttgagtccaccttatcctttacatttgaggaaactgggggcttttaaatgtccataatagcagcggctttggcagccacttcatcccagtttgctttagatgttctcttctgtaacctctcagacgctgatgtttaaaatgagaaacccgaatgcatggtcacaataaaaggggaatgcttttttattttttttttaagagaaatttgtcttcactcctatcactaagaattttgaaaaagagaagaactcatatataaattaatataaagtttcagttgattagtctttgatgtaaataaatatttataatttgacaaacttaataaatggtttgttttcccagaaataattggacaattggtgtaaaaattatatataaatagtttgggcttccagatatattaataaacattgatcactcaccagcttggtggagctaaagtggtttcatgactcagctctgaaattggtaagttgtgtaaccttaaaagctgcccaactgctctgtgcctcagtttcctcatctgtaaagcagagatagtaatagtacttacttcgtggggatattgaggacattaaatgagctacaacatgtaaatcacttagaaaatggtaagtgctcaataatgtcagttattatattttttctttatggttaaaattaaaagatgaaatgagatcaaaaaattaaatactagttaattgtagtgacattaatgctctctaatctataaactacttatgcctcagtttcccatttagtagggtgttacaagaaataatacatcatggtgctttgtgggttaaatacatgttcagaatattctcatcatgtaagttttcacccatgtagtaacattgcctggccaaaatattagcaaaatttatttagtaccttacaatatgttgagtgccttaacatgggttgttgccaagaaactaggaataggccagtatagttgttaaaagggccatccagtaaaacttatttatctttttactttttctttccatataataacttgcttctctagtctacagtcgaagtagaaaaataggggtaagaatgccatttcagacactgacctcaaagtgacagctaacaaaaacagaagaaaaagcaaaaccccaggaaactaacacacaagctcatgaaacacagcaattgagggccatttactgtgggatcagttagccccaaacactgtggtgtatctttaaggaagcacactgtttcatgagctgacaacaattaatgtgactttaagataaggttacattgtatttgcatttccatattatacatatatattatacatgtatgtattgtatatgtatatatgttaaaggaaggcaggaacttcctcaactacctacagaactcagcgttcaagttaactcattcctcaggaattctgaatagccaagatcttttatgaccgagaagaaatacgccaaggacacgcctgtaatcccagcactttgggaggccgagataggcagatcgcctgaggtcaggagttcaagaccagcctggccaacatggcgaaaccctgtctctactaaaaatataaaaattagccaggcgtggtggtgggtgcctgtaatcccagctactcaggaggctgaggtaggagaatcgcttgaacctgggaggcggaggttgcagtgaactgagatcgcgccattgcactctcgcctgggcaacaggagcgaaactccatctcaaaagaaaagaaaataaatatgccaaggaattaattttttcatcaggtttaaaataagttgttatgatcattttttaagtgagctctttgcaagctgcccaaatcacaagagcactcaacttagaaaagaaagcttttccacatgtctgtcaactgttccggagactatagtacagatagatggaaaccacaggccccttgtctactcaaggtggggagaggaaatagattcaggaatggaaatagagggctagcatttacttttgttcaagagaatgatgagaatggaatcataaactgttttcttttaagatagatatttaaaggatttattgaaaatgtagcttttgttctgatgagattttcattagaaacaggtgtgaggagactagttatcagtgaaagaataaataatgccatcaaaaaataaccaaaaaaagtataataggaaccagtagaaagcagaaacaggataggaacttgtaaaattcatcaacttccttaagcagttttagacattttctgtatattttttcatccattggatagggttctttgagttttcaattagaaaatatcctgtaatttttaataggttcttgagtaattatgactttttttctatctttatattcgtagttctcttggttacattttttaaaaaaattatatttacttaaatgagcttgaaacttgaggtgactaaaatgtttggagatcttacattttccaaataataaacctctattcttaattttgttaatgcctatttattatttcgtgctaaactgcttataaattattttcttattaaaggtttcaaacactgtaacgtacaaaaacagggcaataggagcaaacaaaaatgcaaagatcacaagaaaaacgtcttttgggaagtgggattatactttacggaatgttctttcatatccagatatttgtgtatgcattgcctattaagtaatcttgtatccctgtctttaaaaatcaaaaacaatgaagcaataatactgtttcatttggtttatcagtaggttcattgcgaaacctactctgccattaagagcatgacatagatgggcttaaggcaaaagaaattatgatcattggatgccctctgctcctgtgctgctttgagcttagctttgagatcctaaagaggtagattcctaggtgatagagtagcctaggaagattcctctgccttttgattctcctctggactttatttgatgcttagattatgagattgtcactagaaccagtttgattattctcgtcatcccagttactgaagaagaaaccaaatagaatccctaatgcctttggctattaaattattgagtaaaattgatggaagaagaatacaaataataatcgttaagtaatagcagctgtaattaccatccattgagcttggtactggactaagcatctctggtgtaattctgtgagatgaatattactgtattcattttgcagacctggtcccagacagtacagtgtataagtggcagaacttgaagctcacttctctcttactgcatagccataaccattaatcactgggcctacgctgctccatgtagcatgtgtatctaggttgatctcacttgacttgtaccataatcttagatttaagtaatatttggtataatttttattgttacattaaaaatttgctacaagttgactgcacaaactgctactatgttgggccatgttcagaagccagaaggtactgtagaaattcctgagaataataattgcatcattctagaagttagagaagcatgcccagctgcagcacagccctgattccatgggctgggttatcagcattgtggcagactttagaatcaacttccagtgtggaggtgacacttcatgtgcagttgatcaaagccaccgtacagctacctgtttgatagctgagacctaggtcctgccaggaagatcactaaaagcagcccccaacaagattctctagggctaggagtattcataatctttataactacatttcatttcctgtagtctcatgttctttctatatgatagatcttttttttctgtgagagaacagcagttgtttataatatttctagaaatattttggttttccagtagttttttttctagatgattccctttagattagcagtatcatcccagtgggcttggttctaataaagtaaggagcttttaaaatgttttcagtgagaactagattggaataaagtagatcataatgcttgttttcagtttactatttttcacataataaggttcactaaagttttgtttttttttttttaatcatcaataaaatgccatacatcttgccattctaaggaagtggcatgaactcttcatttactggagaagacttgatagtaattttctcagagattttatttctcctgatgttttcttgagcaatttggttactgtaagagctttaaacatttttggccttctctcacagatcttaggaaataaattgtagtttattttcctcccttcctccctcccttcctctctcccctctcccttctgtttccagaaaagtaattagcatttattgaatattttcgattttttaattgacagataaaattgtatatatttatcatgtacaacatgatgttttgaaatatacacattatgaaatatgactaaatctagctaacataaatggtactttattttcatgtctctgtgctgagacctaacagttggattggatgcccttaaagttggcatttatctttaccataatttggaaagcttcatggtctgtcactgttttttactctatcatttttacaaaaatactttaaaaagcacaaaattttttaggtttctctgattcgtattataggaagtatttagttgtaatatttagctctcaaaatgaaactgtactcagatagtgttacttctgtatcttcatgctgtgacaagttaagattgctcactgagaatttagcacatgtaagaggtaagtaaaacagttagggagggaggtgccacccgttgtatctacataaggagactcattcttcctcttcctttgaagaagaaattactcagaatccaggtattcaggaaggtggtctggcagttgtaggtcacctgtaaggcttagttaatacatttagtgctcatattagatgatgaagtttataacaagccatttcattctgtgatttgtagctgtggtggtgaagaaggaaaaacctctttatctagtggttcctcttgaatagtggggcttgaggcagaatgcagtggaaacaaagtagccaacaacacactgctttccatgctcttagctcctgcttcttgactctaatttatagtgccagtcattatttgtttcacttagtgcttgattttggaagggttgtactaataatataattacaagttgtattggtgtggctaacatgagagattttgaaaaacaatattgtataccatagatgtttagtaatagtatactacaaaagttccttggaaactttcagtgtgctgaattgaatgacagtttaaaaaataagatgtgaggttatatgggaagaattaatgcacattgtgagtcccccaggaaagttgggaaaaagcgtgtgccctcttgcccttatttgagcacgaaatccttagtacctgcaggatttgtgttccataaatataccttgggaaaagctttagtagaattttagatgttctcagataaattatatttcaaaagctgctttcaaaatgggaacttgaaaaaatggttatggtcttcacacaaatcaaacatttttgtgtgtgttaatctacttagcaaatattattttctttaattctaggatagtattttaagcataactatccaaattgatagcaactaaattaattttttcatctcagtacttaaatatgagacaagatacagtaatttatttgaattatatattttgtcattttaccgtccagtatttttgcatatgcagttttttttttaacctgttacctgggtagtaatgagaggcaaaaagatgataattgtggaagtttgaagtactctaaaatataaagccctgtcttttttgtttaattatcgtttacaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggtaaggtagatacttagtaattgtcctctcatccatttcataagtagggccacctatattgcatctattgtgcaactttctattgtctattttatgtatcactaaaatggaaaaagtactaattataatttttaaaacttcatttgattataaaatgccagttgattttgcatatattaagatgtgataaaagtacatcttagaatctatgaaatatggcatttaaatgaaaggatttctatcacttatttaaaaggaatatctcacagagatctgtttaatagtaaatcttgatgatgatgatgatgatgatgatgatgtgtgacctctgctctgtgattctctattgctgttagtagcgctcttgatcctcagttctgtggttttcgtgccaagtattaattgagtacttgcttatgtgccgtttacttactgtaacagtaaaatttcagattgtcaggatcccctcagtctctcacttttcttggtcctccctaagactcttttaagtgatcagtagaggagttctttaccttgggagaagctggggtaggtgtggtatatactgtttgaagagaatattaaactacctgggttgttgaggagttctgttagtatcgcagacagtgtcttgggagctaatgtgggcatccattggcgttttgatagaaagctctggcaactccatgaacacagacaaggctgccaggagcaaaagagcagcagagtgctcctgggcctggccaacctggagcctcatttaccacatgattgcttgaggaacccgcttggtgcttctgcgtggcaatagttagtacccccttaagtagttttatctgggttcaagcccgatcatggtagtcagattgcattgcttcaggcagctggcatagattagactacatagttacatcttcttttacctaataaatgtattttagaagggttgtatttagatcttttgttgtgttaagtactttgaaaacgaaacttgctatctaaaggattgctacaattcatctttttattaaagcaaaaattgctcttttaaaaccagattatcacttccttatctggctgttcctgctatgttgaaggtatgaggttttatatatttggttgtcttaaaacagcagatagcataatactgccatttcaaaggatggcttccaggttccaaagtgttctggtcatggacaccttctcctagtctggactgtggatatctagagatgcttttaactgatacatattattctagaactaaagagaccctctactgactgttttgttctgtttatttctctaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggtaagtatgtcagcttaaagtttgtttgaactcatatagaaatctgaaagaatctttgctggttctcactcggggacacaacaagatgcagcacctcctaggtgtcatctagctgtttggaaagaatagaaggaacatttggaaacttaccaggtgctagaaggtgcttagtaacattcaacaacctatattctcctaggattatggactgctggcaatactcacggggaaggttttaaatggcttctcttcccatggtaataacatggaacttctgaaataaacagtcattagctctctgagttctgtctcagcttcaatcttctcttccttatttgaactttaggcatagaaataagagtaagaaggcattttggttaaaggatattttctccttttttaatcttccattcccttagagggagaaagtttatttctagtcagagaacataaaagatatacttttatttaagcaagcctgtggtaaaatccaagtgtataaaacagttaggggaagtactagctttttataagcatttataagaattctttaggctacttcattagttagatgtgacttaaaatatattcactcatttataaaattataaaagtgactattttgtgtaaagttagatacaactaataggactgctctgaggagcaccagagcaggagagaaagaaaactctgacataattaatgagtcttctcacttctagagtggcacactgattcatcatttgtagctttacggattgtttgggactcagattccggtgctgatccttaggcattggcgtactgtgtttgagttgcagatggtgttggatggcattgttttgttatatatttttactctcctgggatggttgctttgtgggtaatggcagtgacttgacattatcctatcttctcccagctgggtagttgtttgttgatgtacgttgctattcccaaaggaccagggctgtgggttttggccattagtctttgtttcttaattcacgttattattcacttttaccagcctgttttcaaacttgacttgtgttttctccaccaggaaaagcactgccaacagaagtacaatgtttcctgtataatgattcttcctcaataccagcgtaagggctatggcaggtttctcatcgatttcagtaaggattatattaatttctcattggtcttttccagtggaccttctctgtgtgtgtgtgtgtgtgtgtgtgtgtgtgtgtgtgtgtgtgtgtgtgtatatatatatatttaaagatttgtaggtgctttgttggctgctagtatcttttgtcatatagctatatgattctttaaaacctaaagccactgctggacactgtggctcatacctctaatcccagcactttgggaaactggggtgggaggattgcttgagcccagtagttcaagaccagcttaggcaacatggcaagaccctgtctctacaaaaaatttaaaaagttaggtgggcatgatggcatgtacctagggttccacctactcaggaagcagaggtgagaggatcacttgagtgcccaggaggttgaagctgcagtgagcaatgctacccctgcattgcaggccctagcctgggccacagagcaagactctgtctcaaaataaaaatggaaataaataaaacctaaagccacacgttccttttattttggttggacacgaatttttttttttttttttgagagacagagtctcgctctgtcacccaggctggagtgcagtggcgtgatctcggctcactgcaagctctgcctcctgggttcaggctattcttctgcctcagcctcccgagtagctgggactacaggcaccagccaccacaacccggctaatttttttgtatttttactagagacggggttttaccgtgttagccaggatggtctcgatctcctgacctcgtgatccacccgccttggcctcccaaagtactgggattacaggcgtgagccaccatgcgtggccttggacacgaaatatttttaaacagctaatattgaataaaattttgtgtgatgtgtagcacatacctttaatttcctattgttcatttacaatggaactcagtttcatgcagtaatactaataatactaaaaacattgtataactacttcaattagagctaataaggaagtactgtgggccgggtgtggtggctcactcctgtaatcccaacactttgggaggccaaagtgggcagatcatgaggtcgggagtttgagaccagcctgcccaacatggtgaaacctcgtctctactaaaaatacaaaaaattagctgggtgtggtggtgggcgcctgtaatcccagctacttgggaggctgaggcagaagaattgcttgaacccgggaggtggaggtttcagtgagccaagatcacgccactgcactctagcctgggtgacgagcaaaactccatctcaaaaaaaaaaaaaaaagtactatacctgccgtatttttgttatccagttatctgagaaaatgtgtgcattttttttagttaggctctacctagtggttaaacatctgcaacacatctttaaatatctgaagaagtgaatgatagagaaaattgtttaatctgagttcaaaagtgatagctcacagttctaaagagatcattgtgggatctgtgtaatttgagggaatattttacctcagatattgctatacaatgatatttagatgaatatatgcagaactaatggttcaaacaaaggattttgattctagtcttgagatgttaattaagccttctcttagctttagactgtccttctgtccatattttattggaagcttgtgctactggttgttttacacattttctggtctttttagatgagcagtaggggatggaactcagattacttcctttaatgttaatatattgttttgaaataggactcatgattagacatgttatatatgccattaaattgcaaagttagggaaaatattttacttttggtgattgggggtgtgtgtgtatggtatacaaacagtccgtgcaataacagtattgtttgtatttacttttcctaatgtaatacgtttccaaattaacattcttagactgcttttatgttttctttaatgacagtaaaaatacctttctctgccatctccattttcgttgcttttccttagaagttaggcctttgtttttcagttcttgagagttgtgcactatagaggacagagtccacagttccacacttatattggcagtcctgcttgcctagagttagaatgataggtaattgtgaggagttttggttgaagtgaaagattgtcatctaattcactgacagaactacaattttaataggattatgtgaaaatgaaggcattcttttgtacttctcagttcagatacagcagttgccatctagtggtccaaataaagcatgcaaggcttgttttccccaggacgttgaacgaaactgttaacagtcctgatttttaacacttcgaatattttaacaaggtgattgatattaactgtagacataataatactaacttagtcttcaatatatataaattatgtattctttctgcagatttgttttgaagtagttttgcaatttgtttctctctttttttttttggaaggaatttacctttggagttattcttggttgtagaagaggggattgttattttggtgaatccagtttttcagagttgctgacctagttctgatttgagttatttgtgattctttaggttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccagtgagtatcacatctttttgtatacctttgaaagataattaggttgaagttttttggatcagccagtcagattattgatgaaagggcattaactaatataaatgatatacttggtgataatgagatatcattttcctttctaggatattttatttgattgactatatatatggtctatatatagtctatatatatgctttttaaactgaattgtttttctgatacccctaatttttggacctaagctactgaatctttcatcttctagtattgggagctctttcacaatacaagaagtaaccactctagaaacagtcattaaataaaatgcccatgttaaattttcatataaatggcacaaagtaaatatagattgaaaggaagaacagacagttcacccttcactaaagtggtcagaaaaaggtcacaaagaaaggaggcatttgagccaaataaatggagaataggaaagagagtgcagaagagcagcagaacttctggagcgggacgtgtgagacagcaggcagtgaaaacagcccgcggccacggtagagagcgaagcatttgtcctgcttcacactcctggccgtctcatgtggtggcacatttctgcattccatcgtcccaggcaggctatctttgcagcacctatcatcttacatgcttcaccaggggtctcatctccacattcatttttatgtacaccttgtacattgttgattgctataaacttttctctggttccagatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtaagggcatgaatagtctctatttttgatgacagaagatatatttttgatttcatgagtatttataataatgtattatgatcatctttcacagaaaagtaaattcacattagaatgtcaagagttttatttcagtggtagagatttcaagaagactggacctggtttacttaagtatttttaagccttggacaattaggaggagaccatcaaatttcttataatgtgttacttgtgagaaaaatatttgttaccagggtgccaagaagcagctcagttttaagctggatagtagttgagaaatctgaattgaatccaaatctgacagtttttaaaaatgaaatggaggttgggtgtggtgtttcatgcctgtaatctcagcgctttaggaggcccaggcgggaggattgcttgagattaggagttcaggacaaccagggaaatatagtgagaccccatctctacaaaaaaaacccaacaacaaaatgaaatggagatacattttccttaaatagaatattaagtaactattgtaaacttgtgtatgttttctgatggggcaccaaaacatcctgtggacacacagatctctttagccgttaaagggttgctggtgaactgtagtgcatgtgtcattgtcagtatttttcttcatgtgatgcatacttttatagctcttttttttaagcagtgcttcatcctttcaacaccggtatcctcctttaataaacataaaaaatcccatgcctctctttagtgcagtttaatttttcaaaatgaaattattcagaataaaagtaaatttaaaaactacataaactttctttcatatttctcaaatgcctccttcctcttgcccatgtctcaagatcctgtctcctccaccctgtttacaaatttttatttctgagaaattttattaaacaatctcatttaacatttaaaagaacaatagtattcactttgcttattgagggtggtactgcagaaagattcagaacataggctctggagtcagactgccaggctttctatcccagcatcttctcttgctcttgcgtgacctggggcagattacttaaatttttttctaccccacatgcctcatttgtaaagtggagttgtagtggtaatacttcatatgattgttggggagattaaataaataatgcatatacagaatttaaagcagtgctgaaacaggaaatatccatgttaaataactgatcattttctttttaaagctcagtttccttttcttctctcaatacttaaaaggtcagaataggtaaatgtaagcaaacaagactgaaaaattaaccagcattgttttattttctaaaatcaggtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaaggtaacgcatttctttccaggtcttctcttcctccaattccagtttatcttacaccttctcgttttagcttacagttctgaaagagtataagttagaaattcctagtgcattgctttataaaccttaagcctctgtatattgtagctcaagatcttcccagtgaacatttgagatgtgtgtgtgtgtttgacttctttgattcatgggaattcacttagaaatcataagcttatttaagggcttcacctcctgggatgcaaacaaacttttttttagcttactggtttgatgttcaaatcatgacttttaggggcttaaagccctaaaatatctttaaaagatatttttaaagtatgtacagattagaagtgtttatattagaaaaggaggccaaaatattacataattaattggaaagtgaacatagtgctgccctatattttggggtactcagagtacagtagctcatcttgggtgctattgttttctctctactctccccacttctcacacatccctccagtggtttaacgtggtctctcttgctttaaaaatattttctaaactatattccatcataatgatagccaattagttattaaataatgtacaatgatgataatgaattctgttaagccgtttaccagaaacatcccaggctatggagtggattttaagcattgccaggaggcagccagactgaagcgaggctgctccctggaagagccactcagccagcttccagccaaagcagcacaatcgttcctttccttacagggtcttaaaaagcaagacaggatcttttgttttgttttgttttgttttaagaataatatcttcagagcagttttacatttacagaattaatgcaaagaaagtacagagagttctcgcataccccagccagtttcctctattattaatcccttgcgttggtgtggtacatctatcacagttactgaaccagtgtagatacatcagtaactagagttcatactttattcagatttccatagttttccctaacgtcctttttctgttccaggatcccacccagcatatcgcattacatttagtagtcatgtgtctttaggttcctcttggctgtggtagtttctcagaatttccttagtttcgatggccttcatagttttgagaatgactggtcaggtattttgtagatgatccctcatgatattagaatggggtaatatattcttgagaggaagaccatagaggtaaagtgccattctcatcacataattaaagggtacctgttggcatatatctatcagtatgtatagggaagctgggcatagtggtcactcttgtaatcctagctacttgggaggctgaggcgggaggatcacttgagctggaggctgtagtgcacaatgattgtacctgtaaatagccactgtagtccaacctgcgtgacatagcaagactccgtctgtaaaaataaaaagaagcaagtatcaaatataagggtattatcaatttgatttttccctattgaagttaactttgatgacctggcttaagatattgtttgtcaggtttctacttttcttttccctttactggaaggaagtcactgtgcatagccacacttaagatttctaccccctcagagtggaggctcagcataaattatttgaatttctgcttgggagatttgtcctttctccctcatctgtttatttatccaagcatttatttatatcattattggcccagatatttacgtgatacttcactttataatccaatactactgctttttaaaatttgttgctcagattgttccagttttgaccattagaagctccttcttttagtttccctcttgggctgctgctgctttttttttttttttttttttttccttccccagatggggtcttactctgtcacctaggctggagtgcagcggcatgatctcagctcactgcaacctccacctcctgggatgcaagcaacgctcccacctcagcctcttgaataacttggactacaggcatgttccatcacgcctggctaattttttgtacttttgatagagacagggtttcgctatgttgctcaggctggtcttgaactcctgagcttgggcggtccacctgccttggcctccaaggtgctgggattacaggtgtgagccaccgcgcctggcctcctgtgtttaacatatatactgttgttgtcattgtggggtctttttgtttgtttttaagcatttcctttctggcactacaagatgcttcaagttcatcttgtatatttcatgcccttgtcctagaatcagccttttctccaaggaccagggccatttttaatctaatttgaaaattacattctcgattgggactattaagtttgaagtagagaaaaattgaacattgactaactgctgttcattgcatgatcatgaagaatagatctttgtcatcctagcacttgtattgccaatttatgaagtaaaacaaatcatgttaaaaaaagaaaaagaacaggcagtaagctcacatgcaaagtaattttgaagttaatgaataaatgctttgactggatgtgtgaacttaagcaagtcctataccctctctgacatctatagaatgaagggattggattagataatctctggggcatcatctcttattttgtgatattagttgtataattttagctatttggtcagtccagtgcaaagttgtgctcagtgtgcccaaatttcagtaacagatttattttacttttgaaatatttcactaacactgagtaaatacatttcagccccatatttctacattccacagctttttatgagtagttcatgaaaatggcatacaactttactgatagttctgcaaaccttcacagtagtgctataagacaaagtgtttttatttctcttttgctcttaagttggaaaagttaagggattagcctctgggtcagttcagtattaaaacagggcaactctctagggtgctaaatttaactgaactattaagagaattataatgtctgctatttggagatggctgcctattcttttacaaagttgtgttcaattgcctaatacctttgtatttataataagtgtattatcttactatagtattttgaaataatattcaaaatattttttggcaaacaacatcctcattttatatgtgctaattctatttggttttaaaactgttttcgtattattaatagaaaagatagtgttcataactgtaaatacttgctttctctattaaacagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatggtatgttttacagaactcacttactgtggtttattgtcttcagatatatagcagtagcagtgacagacccttcagtaaaaaggctgaaaaatgaacacaacccactaagcaagaaaaggaacgtttggcaatctctaaaaagttgtatcaagtatatccatcttgatttttaaatgtgttttcccttcaactcagaacctctattaatttgcctctgcagaaaatatcttactattaggcaactgttcttttttgcccaatcctttctaagcctttatcagaatctttagttaatgggagagttggacttagcatcaggaagatgtaataacccttcactagaatgtgcattctctagacttagtctgttttgctcattgctgtatgctgagtgcttaagcccggcgctcagtaagtagtgttaaatgagtgaatgctaagaagacaattctccagaaagagcagattcatgtaaattggaacttgtgtcacatctgttcaggagtctttcctgaattgtatctctaatgtgtcttacccaactagtagtaaatttctcacaaatggtaacaataactcaaaataaattttatagtatagatacaaatccaactatttacttttaaagcagcctagttgtcatttcttctctagagacactgaaactaggtctcatatatatgagccaggtcagaaacaagtctttttcaccctagcctaaagttttgccagtgtctcatgctgcctgcatctgcagtgtgtttatctcgcatgggctcagaatgagcatttttactttgttgggcaaatttgaagaaatctacttgtccagtcttggtacataaacctttagcttttatgcattaactggttgaactttttaattcttttaaaaattcagtcagtttcaagtctagaagataaacttacattttctccattctcatattttctatataacaaatacttttttattttttattttttatttttttgagatggagtctccctctgtcacccaggtgggagtgcagtggcacagtctcagctcactgcaacctccacctccgggttcaagcgattctcgtgcctcagcatcccaagtagttgggattataggtgcacgccaccatgcctggctaatttttgtatttttagtagagacggggtttcaccatgttggccaggctggtctcaaactcctgacctcaagtgatccacccgccttggactcccaaagtgctgggattacaggtgtgagccaccctgcctggccaacaaatacttttaatatagtgataagatgaatgtgttctttgctctatcatgaatgattctacagagtttaacttgctatgttttgaaataacataactaggaaactaaaaatttattttgtaaatttagcactttatattctgtcttagatcattgtacactaaaatagtacccctgattaagttcccatggacttagatttttgctgatgcagccatttcctttgttgactttcaagttactactactaactgtgcctttttagccgtgcccccactgcatcatgttcttgtcttggtattcttattctttaaaaattaataggcaatgtgagtgtacttaatgccactgaacttaacacttataaatggttaaaattttaagttttatgttacgtatagtttaccatagtttttttaaaatgctaataatataaaatttatttctaatgaatgtaattggtgctttaattttttcttgtttgtctaagtctaaatgtcagtttttgtctaggactaaataaatgctttgcagctattcccatacaaacacaacattaattgaacaactgttcacatacgatggctcagtcatggcctagagtaattggctcatcatactacctgaagtgatgatttgtggaaagtaagaaaatccgagagataaagtaaatcacaagcagaaaaaaaaagaggaaataagctaatttgtaacttttagtagagacaacttgataaaagtactgcttactacttatttgcctctttataaagttcatctccattttacagatgatgaaactgaaatgtagagtaacttcccacagacatgcagctgatgatggtagtcttgaattggttctgactagtgtctgataacataatgttgaccaggattctttcatagttctgccaattcactgtgtgacttagaatatgtcactaattagttttatcctctaggttcttaactttaaaatgaagacaatcaggagtttataaaagtaatgattaataaagtcatttctattgtatatgctagtcttggaagaaggaactagaaaatgtaagaccttgtaacctgtctttgttttttttccttcctgtatagacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaaaaatatatatatatatatatacacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactattttaagaaagataaattctctttaaagagatctctagcgtgtgtgaatagagctccagatgcctctaaaagccgcatgtacaaaggaagccacgtctatcctgtctgtttatatttgcttttcctgttttgtaacctctttgtactttgttcatggtgacttgtaagctaaggggaaggggtgcctagatgcctttgtatctctccatgtcacgcgctcctgggccagccggcctcccttcctctccttgtatgtaatacctttttttcccctttctagcaagtactttcaaaagaactctgtacattttaacataaaaaataaattatgttgagccattttgga

SEQ ID NO: 10 - DNA, 27451 bp, Homo sapiens
ctactgcgcgtgcgcggcgctgcgacacactccgaccccatcccgcgttcccagggggcggtgggaagcggaagtgctccgctgacccgggagggcggtccctagttcacactggctgttgtcagcggcctctgaggtttcaggctcttggcggtgaagtaagagggacgcggaggtggtgatggttttgatgggggcgggggttgacggggtcgtggggtcatggggccatgggtgaacgcctttgtgggtgacagggtggctctacagcccagctcaaaagcccatcctccaggccacttccccgcctgagacaggccccttgctctcaggaccctctgagccaggaccagggtccggttccctgagacccgcaggcctgtgggcgtgagtgctggggacgaggttcagggccagcgagtgactgattgagtcactccgcgcctgtttcctgagcgcctaaaaatgccaggcaaccttgcaaatgtttcacattaatcttcacaggagccctgtgaggtgttacgatgattattttcgtgttatagagagaaaatggctcagtgtggcttgacaacctgtccaaagtcacgtaggtagcaaacccgaggaatcttttttttcttttcctgtgcttcgtttatcatgtttattgtttcctgtgtgtctcccccgctggactagaaactctgcgggagctgggactttgagattttgttccctgatgtatttccagcacggagaacgggctcatggaaggaaggcacccatttcttcagtgaataaaagtggcacagcagtcagtcagttgattccaaagcccggactcaggaaggcagggtttcgctcactgaggataattgagctgtgaatcaatgttaactcttaaagctagaatgaggcattgtccctcttctgctgggtaaaacctttgggttttactcaacttcactgcatggaagggagcataggtgttgctaattgaatctcctgtggtcattgtgtttccagggtcagagtgcagacctgagaccactgctcaccgacttcagactccagtttatctgtgccccagcttcctcacttagtctcagaagacttaggctgaggcctcagaaggaggtgagttccctgggtcacaggcagagatctggtgctatagtgatggcctcaactggggcgtgtttgtctctgaatcccttggtcctgcggccttggacacaagagaggtacgctgagctgaggcgagttggaggagaagcctcagcccagagcccagacccagatcctcagggcagagaaaggaggctcacaggatagcaggtcctagaagagctggacccatagtggcctttgtccctcacttcagctgagacaaagcaaagctggctcaacttccagatgccatcgaggaccgtgtgacagtgcagtttgattcctgctggaggagggacaggtgaaagtcacaggtggatggaggcatggatgtccccccatggggcaggtgccctgctgtagtgcctgtaaaggcgctatgaggctgggaaggatcacagccagccacagaggattggcctctcctagcacacctatttgtgcacccctgtgttcccgtctcttgccattggctatttctgaatttgagtcagccccacaccatcaatcaggcacctgcttccaggggaaatgctgagtgtcccttcatcctgaccaaagtgcagaaaatatatttttagtttatagaatttccaagtagtctctaggtacgctgtcatccatctctgctgccttatttcaatgcttaatgaaagtgggccaggggacatgacctgctaagccacaccaagctgaaccctgttgtcctgatactgtcacaatgattgttgcagtatgcaatggttactctgcacagaagctccttgctggaactttatttgaaaaactaccaaagaaggaggagcctggtaatcaaaatgcaaattgtgagaaaggagaaaatgatggggtgggaacagggtaggtggccagttaaagaggcagatgcaggggagcaggcacggtggttttcagcccctcacagaactgacagtgctgggctgttacccacccagccccacacctctcctccactgtggccctctgagcccctgttgggctccttcctccaaaccacatcaagagatcctacttatacacacttgcagagggtcttttcacctctagggctcggtttgataagtggtgatttttaataatttttaatttttgttttactagtgatattctttgtcaaaaattgagaaaatgcaaataaaagaagaaaattgaaatcaccactcaaaagtaaccaatatcagcattttaataaatcctctgagacatcatatatgtgcatattgattatcaaaaatgagatcacactgcgcttgctttcttggaacctgcttttaaacacattaggaactaaaaacaaattccatagcattttgaaaggctgttcagtatacctgcttttgcatgtgtcatattttttaactgtgtcctctttgctggatatttagttgcttccaatttttttgtttatttgttttttgtttagacagggattccctctgtcgcccaggctggagtgcagtggtgccatcttggctcactgcaacctccacttcctgggctcaagtgatcctcccacccagccttcagagtagcagggactacaggtatgtgctaccatgcctggctaatttttgtagagatggggtttcgccatgttgcccaggctggtctcgaactcctgggctccagtgatctgcccacatcagcctcccaaagtgctgggattataagcatgagccactgcacccggccgcttccacatattaatattttaatggtagaaatgactacagttaacattctttcagcttttccacatttaggaatgtttcattatgacaaatgtctaggaatagaactcttaagataaaggagatgttaattgttactggtttctaaaatagatatctttagacgtaagtcatacatctgtccagtaagggaaacaaaatttcatgtggaaaacctacatgatcttagtagagtttcatggaaacaggctggagctaccaggtcatgtttttagatcactctccctagggtacaagggtaattattattgggatggtaatgatggtctaatggctgtacctaccgaatgtactctcctaattttgcctttatagatctccatcctttgtccagagcagaacaggatggccatgtcccaggtgagtttctaatttacccatactttgtttccagtgaaattgaggcaaggtttggaatctatatagcagacttgaaaataccaattatcccctcttctctggctgttttctattcaacttgttctcaacctctggtttctctgatcctccccgtcaccaggagagaggaaaaacaaagaatcctctctctacttcttgttctttctttttctttttcttttttctttctctttttttttttttttttgagacagtctcactctatcacccaggctggagtgcagtggtgcaatctcagatcactgcaacctccaccttccgggttcaagcgattctcctgcctcagccttctgagtagctgggattacaggtgcctgccaccacgcctggctaatttttgtatttttagtagagacggggcttcaccatgttggccaggctggttttgaactcctgacctcaagtgatccccccacctcggcctccaaagtgctgggattacaggcgcgagccaccatgctctctacttgttcttctgagaactgtacctcatcttctcttcatttccttctcacagaagattgtttacatacatagattcatcttgctctttcctctttcttcacttctagatcacttggtctttttcatcattcatatttatgataataagtttgtgcataatgttttgatgtgcgtagaaaaagctagtagcccaaaagattctattccttctcccccaagtaccatgttcctcgtcagagatgcccactgttaacagttgggttaaatggtggggtagatgcatttatgtcaatttaatgaaccaaaaacatatacacatgtattgttttcatgcttttacacaaatggcatcatactcccatacccatcttgccttttgcacctgattactttctgggtggtgttccttgtcgatatataaagattgttttaatttctatctcatagtatggatgtcttaatatcatgtaactatttatttatggatatttaagtttttaatttttttttactgttgtaaacagtgcctcataaacaactttctctgtatctacttgctctgtagtaccagtgtttatggaggttatacctggaagtcgggttttgactaaaaggtactgaaacttaagttttgccctccgaaatccttcataattactcctttcactaaatgtaaagaccagataatttctgtgttccaattttccaggctattaaagatgaaaaggcacccagttcattttgtgaagccacttaacctgaaatttgaggaagatactacaaaaaagaaaattatagaccagtttcccttaagaatataaatgtcaaaatattaaaaatactctgaatagaacattaacaaattgcattgggcatttcaaaagcaaatggatacacattgtaaaaaaattcaaacaaaagctttgttcagcaaaaaaaagttttttgtggtttttgttttttgatgcagggtctggctctatcccccaggctgaagtgccgtggcacaatttcagctcactgcaacctccgcctcccagactcaacaatcctcccacctcagcctcccaagtagctgggactacaggcacatgccaccatgcccagccaatttttgtattttttgtagagatggagttttgctatgttgcccaggctggtcttgaactcatgaatctctttctctgcctatgcacaatcactcgttttctcctgcatgtgctctctctctctctttctctttctctctttaacaagttacagtacatcctggtctttctggtcctttttttttttttaacgaacttttcacttgtattaactctacaccagggtttcttagtgtggcactattgacattttggttgaggtcattatttgtcatgggttgctttcctgtgcattgtatatgtaacagcatccctggactctctctactagatgccaatagtgctccctcctccagttttggcaaccaaaatatctcttgtcattgtcaaatattccctgaggaataaaattatccagtgtttaaaaccagtggcctaccccgcttacaaaaatggctgctttcatttgatggcaataccactatttatttacctttctcctaataatagatatttaggatattcctagtcttttgctaccataaacaacatagcagtgtatagtagattcccattgtgtacatgtgagaacatttataggataactttctaaatatgaagtttctaggtcaaagtttatacatcttgaattttgattcagaactgtcaattgccttccaaataggatgtactgatttgcatggctggcaacattataatgccttttcctgtaaatgggaaatcacagtgtattatccgctgtgatttttgccattgtgagggagaaaagagtcgtgcattttaatttgtttttcttgatttgagtgtcttttttcatttttaaccaccatttgtacttttttctttcaaatatttattctagtcatttgcccccttttctcttgggtgtggaattactttgattgctggatgttagctccttgggttaacttaagcaaatgagatctctgtcatacatgttgtcaatatttttcatagtttattatttgctttgatttgtcttatacatcttggggagtggacacttaatgtgtttttaatatctaattttacaatattttgtggcttctagagttcttgtattgcttaaataggattctgtgagttgagattataaaaatggcatttcagttatgtggaaaaagtggttactgaatgacggtggcaccgttgagtctccgtctggatggaaagaaagtgaaactcttctacatcatataaaagtgaattccagattgatcaaatacctaaatatatatttgaaaaattaggtgacaatttaagaggatattggtataactttgcttagtgcaagaaacttttttttttaaatggtacaatgtttttcttttaatgatcattgggacatcttaaaattaactactaagtaaccacataaataaggaaacataagaaatgccataacccaagtacttttgaaactacttcttagttccaagccccagcatgtatcaattgtatgaattaattttttttattcagaacctggatctttgttttaagactagtataaacaaaaataaaatgtaaacaacttgttattaacataatagctgcagttattaactgcaagaatacagtaaaaaagtcatactaaatgttaatgttcttgtaacagaattatccatatcaccttatggtagcaaattctggcaagaaatgatcattcatttcttattaaaaatacttatttccaagatcagttataccacaaataaaaccacagtttattcaatagagcccttacctttctctttttttcctgaaagatctgccatttacagggaactactaatttcagatcagttactcaaaccagggttattcctgtaaatgtacatcttaactttatatatagtaggtgtacactcatattccctctctagtcttgaagctaaacactttcacaaaagaaacaacctaaaatcacttcatgtgaatcttggttcttacttttcttctacctcatttgttcttcctcctcatcacaaaaattatcttcctgcatggtggtaaaggagagagatctagcagccacttctacagcaaagccatcagtgaaggtaaaattcagtgacagctgtagctgtgccagcctctgctgaatggaagtctgtaaggactccctgggagatggaggggtagtggccagaacgcctccatctgcttgagattcatcttcgccctcacattggtaacacattctgtcttctctccttggaggaagacttcatttgcagaattgtctttatttttaccctctagatcaagcttgtccaacccatggccccgggccacatgcagccgaggacagctttgaatgcagcccaacacaattcgtaaactttctttaaacattatgagatttttggctgggcgcggtggctcatgcctgtaatcccagcactttgggaggccgaggcaggcggatcacaaggtcaggagtttgagaccagcctgaccaacatggtgaaaccccgtctctactaaaaatacaaaaattagctgggcgtggtggtgcgtgcctgtaatcccagctactcgggaggctgaggcagaattgcttgaacccaggaggcagaggttgcagtgagctgagatcgcgccactgcactccagcctgggtgacagagcgagattctgtctcaaaaaaacaaaaacaaacaacaataaaaaacattatgacattttattgtagtttttttttatttttattttttttagcttatcagctgtcattagtgttagtgtattttatgtgtggcccaagacagttcttcttccagtatggcccagggaagccaaaagattggacacccctgctctagagagtcttcacataaatactcagtcttacttacttcattgtcacttgtggagtgtttactattttcctcttcagtatcatttttactgaattttcctgtatctgaattcattgatggttctgaattacttgtgggttccactaggtttacaggagacaaggatttcaacacagcatgatcactaagtagaagttataaccacttctgcctttctgcctctgaagctttaaatcccagcacagattttaattcttagagcaccctcttggattcttcatgctcgtgcttctgtctttctttgtcttcctgagacaagtaataaaaatcatcctttctgcaatcactgtcaatatctatatcatctacataagcttctaagtcctattcatcctcctcagggagtggatctttgtcggcaatgtgtagagtaggctgcatcaaagttaccactgtacagtatgggttttcacacactacctcaggcttgccttttttaaatctgtatttcttcatagcagtttgtccacctgagaaatggcctcttcccagcaattgttgctagtttaaacatggggctgaatcaactttaatttctgttctaggatttgataagcctctgacactgttcttgtttctttaatacaaaaaagcttttcaaatttatcttcgagaattattaccttattcagtaatgctttcacatggagctgcaagttgtacactgctgtgtgaacgttattcagttcttttgacttctgttgagttttggataaacactggtactgactggtgctgagtttcaaagtactgatagaattcagagttgctcttaagctcttccaaacaggcatagtaagcatgaggtagaccttgagtcaaatcagataacatatgatgaggcaaaagtgctgaagtaagtaagggcccaggaggtgaattggctgtaggaagtaataagactaaccatctgtagaattctgaacgctgccatccagagttggaacaaaaccttcaatgtaggcaggctaaagtcatctgtaaagttaggtgcttcctcttctgaaatctactcttcactaagtccaaggcccagctccttaaaaggcacgacacagatatagctggttgcattgtcactttcagagttcagggggtagtttttcagcatctataggatagatagccttgctgcttggaagttctgtagacagctttccagagactgatgaggtactgagtgggatgccatccagctttattaaatgggataaataatcatttatcatttaataataatttaataatgtattattaaattattatatattttataaatataaagtataatttattaattattataaatttaataatttattattaatcatttaataaattatctcatttattaaatgggataaagcactgaccctgtcaagcaaaagtataaatcctctggaaatcacttcagtttcttgaatgagatgtaaagcttttcttacaaggttagtaaaagctcagctatttgctgccatatcttccaagtgaacattgtatttttttcaggtcacttgtagtttagctgtcctccatactctcaaagctcttatgaccaaataaacaaatagaatcactccccataccagccaggaagataacatccaccaagcaggaagcataacgagcaaactaatgaaggcaaatagcattgagacatcccaaatattaggggttgccagggagcaaagtgttggaaggtgtccactttcctgttgttgaggttgtcctgcttacaggatactggaatcaagtagctcagtgagctccacatcctcttgaaacaggacttcctgttgcaggatggtatgtaatgagttgagtcggaatccaatatccaacttgtgaagtaagtcatctttcttactgcgctgagaaaaaacccaacttctggtggttttagccacttttaacagaatgcgttgcttaataacccattccctgagcatgccagtaagtggagtttatgttcaccgagtgattactgtatcccaggtattttggtaggactcttgtaggaggcttttgttgtccctccgtggcgcatttttctgtttttggtgacaaagaacatatttcaaagtctgtgtgtcccggatcctgtaagtactgataaagcggagaattccaaaagctacctccttgtcaaactccaatgtcatccttctctgccatgccacccacttcagcacgatgggaaatcagaagaaacatttttaatgaagatgggaaacctagaaaccataacgagaaagattgtcagattaaactgtattaaaatgttaaaacccgtagaatcaaaagacatatttgaggctgagagaaaatacatgcaatgcatatgatatgcaaaggattcatatatagaaaatgaaaaaggatgaaagaagatgaaaaatgtggtggacatatagtcaaaaagataaggcaagcaatttatgagaaaaaagtgtgatgccatttgaaaagatgtttactttccccagttttcaagccatgaaaacagggctgattttcattcctccctttctgttgcattccaacaaatgaacccagtctcagcccttctactgtttgcctttcagagttttttttttttttttttttttatatatacaaaaccacaacattttgcatgggttgtttttaatgaaaatatgctcctcctatgcttttctgttttggggtttttgttttttgtttgtttgtttgtttgtttgttttttgagatggagtttcgctgtgtcacccaggctggagtgcagtggcacagtcggctcaccgcaacctccacttctcgggttcaagcgattctcccgctcagcctcccaagtagctgggattacaggtgcctgccaccacgcccagctaatttttgtatttttagtagagatgaggtttcaccatgttggccagtctggtgtcaaactcctgacctcaagtggtccacccgccttggcctctcaaagtgctgggattacaggcatgagccaccgcacctggccccgacgttagaaatttctaagcacaatgaaaatcttaaaaattatcaaacatccatatcaaagtgagaaaaatatttgaagtatacataacaatgggctgccttcttttatacactaaaattctaacaaatcattgaagatcacacctaatatatagctgaaagaatatgaaatgtatgtagaatagtataccatgtatcatacttcatattcttaaacattaaaaaggttgataatagtacagtcaagtatgtagaaaaaacaccaaagaagttataaactgtatacagcattttgtggtggaacagttggtttacatatatcaacatttacaatgcaaatacccttaacacagtaatgccctttctagaattttaccctagacctttaatatatcaataagacaagacaacccaacagaatgaagactcatagtaacagaaatattagtggcctagaaacatacaaaaagattataatcctcactaaaactcacatacctgctgtcatttatctgtaagagtggtaaactttgaaaagatagataagagccactgtggatgagagtactggctggttgagaggtaatttggctgtacttattaaatatctttttcttattttaatcagcagttgcattgataggactccatcctagtgaaatatttatatgtccacaaagatttccaaagcagttctattcatactagcaaaaagtagaaggagaaagccctaagtgtcccatgttcctgagaatccaataatggtagaatgatagctatactaccaggtggcattgcttatgataaaaatgacccctgattggtaaacaaacttcacatggatgaggaggactatagaatagttaaataaattgccacatccatactctggaactgttatgataaaaattgactcatatgtaagaatgtctgggatacttttgtctaagtgaaaaaaaccaaagttcagaaaagcatagtaggagcagccgggcatggtgactcacacctgtaatcccagcactttgggaggccgaggtgggtggatcacctgagatcaggagttcaagaccagcctggccaacatggtgaaaccctgtctctactaaaaatacaaaaaattagccaggcatggtggcgcatgcctgtaatcccacctactcatgaggctgaagcaggagaattgcttgaacctggggggcagaggttgcagtgagccaagatagtgccacggcactccagcctgggcaacagagcgagactgtctcaaaaaaaaaaaaagaaaaaaaaaaaagaaatttctgatgtctaggtagtcaagtttatcactctgtagctatgtattttctgaatttggggattgcttagaaaggccatcagccactacaaaactatcaaaacttttaacttatctatcatttttatggttattttgtacacatttaaatctctaatccatctgtaatttacttgggggctcagagtaagatgagtaatttacttttatggagtttcttccctccataaatgcctagccagattttcctaatgacatcttttctgcagagatttaagatacttttattatgaagtaacctctgacactgtacttctaggatctgttagtggttattaactctcattatcattgtcatgtttagctatgtgttactggaagcctgataatggaatgacggctgttttactaggtctgagagatagggaaggaaacccaagtttttcctactgtctcctctcacttgacacaacacttctgacaccatatgtaatcccaggccccaggctgttccctcacataccaagcagttttccctggacaccagctcggtgtgctgtgaagtcaattccattctgacaccatctacctggagttagcgtgagctcccacaggttgagggcttagtcccacaagactgccctgacttgagatgccagtcacaagtagggtgtcacctatacatctgactgatgggccacaaattgggggttcccatgaacccctcctgaagattgattaatttgctagagtgagtttcagtttccctgagtttcccctatttgttataaaggatattacaggcaaagcgcggtggctcattaatcccagcactttgggaggccaaggcgggcggatcacctgaggttggaagtttgagaccagcctgaccaacatggagaaaccccgtctctactaaaaatacagttagccgggtgtggtggtgcatgcctataatcctagctactcaggaggctgaggcagaagaatcacttgaacctgggaggtagaggttgcaatgagccaagaccacatcattgcactccagcctgggcaacaagagcgaaactcagtctcaaaaaaaaaaaaaagctgggggcaggggggtggatattacagaggatacagatgaaccgccagatggaagagatgcatagggcaagggatgtgggaaggtccacggacctttcatgccctctctggactcactaccatccgggaaccaccaagtgttcagctgtgtggaagctgtctgaacccacccagccctttggttgttgtcgttattgttgtttttgagaaacaaggtcttgctctgtcccccatgctggagaacagtggtgcagtcttggctcactgcaggcccaacctcctggcctcaagtgatcctcccttctcagccacccttagtgctgggatcacaggagccagccaccacacccagccacagtggggtttttatggaggcttcatcacagaggcatgatcatcattggcccttggtgatcaactcaaccttcatctcctctcccctcccaggagttttgaggatggagatgaaattcccaaccttctaatcctgtctggttttctggtgaccagcttccatccagaagctacctaggggcagccagctaacagtcatctcattagcatataaaagatactttgatcacttcagaggctattccaagggttgcaggagcttcttgccaggagacaggacaaaaaccaaatatatatttcacaatatcaaaccaggtgacattactccagataaaattgactctggattggtaaacaaactgcatctggactggaggactgagtaaactatgactggctggtaggaagccatggattggggttttctgagcacattgccactcagtgataagtaactgggcccatcttttgctgggatcctcgaagccatgccactgggaccattacaagagatactggtctatggaacaggttagggcttccaagcaacatcatcctagcactcagcagtgtggttttgttccccagcaccggagctatcacgagggaggggcagattgggctaacagctcctggattgctctgagaagccctcctgctggagaagcctgcctgtccccaccctctggcacgctggctttcctgcccctctcctgcacagctgggtaaactggtgccactgtggctgatttgggccttatgggtgcagcgagtggcttgaattgaaggccaccaagtgtgggcgtgacaggatgggatctggagcagaaacaggcgggttattagtctttgcaaggaattggggcgcttgtagaagtgagttcttgtttggtggtgacaaggccaagcacagacctttccccttttgcttcagtcagctgcccaggccacaaacctctggcttcctgttctttgtttcatgattgattagctatgtttagaactgtttgttgtagctctgtgtcccctgtgaaggctgctctgtcagccccaggcaggattgacttcctcctttgtggaccacccggaccccttcctacatctgtcactgtccctgtgaggcaggcttcctccctgcctctgtttcatctatgagtgtcttgagtgtcttaagtgtcacttttctccctccactaaactgaagctccttgagttcaagaggtgtggttttgtatcaatctttacttcacaggacttaccagcccggcctctgttcagtaaacatgtgttgaatgaatgaatttccagggtaaaatatttctcataccctatctgtttctcctataaagttcaaaatgattttagtcatatagatactctatgtaatatactatgccaaactgactagtgactggcataagaacaattatatgagaaaggccaggccgggcgcgatggctcacgcctgtaatcccagcactttggaaggctaaggcgggcagatcacaaggtcaggagttcgagaccagcctggccaatatggtgaaactccgtctgtactaacaatacaaaaattagccgggcgtggtggcgggctcctgtagtcccagctactcgggaggctgaggcaggagaatcgcttgaacccgggaggcagaggttgcaatgagccaagattatgccactgcactccagcctgggcgacagagcaagactcggtctcaaaaaaaaaaaaagaaagaaaggccattgtgggtgtgggaaccagaccgtgtggattcgactcccctcattcctggctgtgtgacctgggttagttacttaggctctgtgcacctcacgctcttcatctgtcaagtttctcctagagggcacagagtaagccctccgtgtgcgtgagatgccatgtcccagtgccccaggctggtcctggggtgctaaagaggaatgtgccattacaggaatcattgaccttcaaggacgtgtttgtggacttcaccctggaggagtggcagcaactggactctgcccagaagaacctctacagggatgtcatgcttgagaactacagccacctggtgtccgtgggtgagggaccgtgccacagggtgatgcagaatgcctccagtactgtgtttctttctcagctgctccaagctctggggcctaggaacaatgagtgtgggttaccaccctcagtgagtttgggttactgcccactgtgtagtattcgtagtctcctttggacactggagagcatattggtgcccttgcttgctatgtgaatgttctgtactgaggggcagatagctgtgtgcatggggccatcaccttcagcctgcaggggtgggcctaggttctggaattcctcagcattaataacgaagtcctatgtcatttcccccgaacagggtatctagttgcgaagccagatgtgatcttcaggttgggaccaggtgaagagtcctggatggcagatggggggaccccggtacggacctgtgcaggtgaggacaggccaggtgagtcaggccggggaaaggagaccaggttggttggtgagagcttggcctctgggatgtgctcaggagcccttctcagagcctcggacttgtggacatgcctaggctctgatgagcagaactgttgtcatgtccaaatgaggcctctgcctggccgccggttacagtctctgtgttctttgtttggcattcacatagattgtggccacttgttctgagatcccatttctaccttccagcctcctggcttgttagtgagaagtgccaagccccttctcattcctctcccaccacctttctggaagcttttaagacttattctcccaccttcttggccttttgtattttcaccatagtagatgtattaatagatgtcagcattttctctttattgggcatactgtgggccctttcaggctgaaatttggccttttttttttagcctaaggtagattatcgtacctgtttttttgtttgttttttgtttgtttgtttgtttgttttgagtcactatggacaccaaagctttgccagtgacctttacccagccaggtacccaccacgttcttgcctgctttcactttgtggttaacactgtaaacctcacaccattttctgttttctctacttatttcttctcagactcttacaaatctgacttcatactacttgttatcagattcctccatttttcaatacgtccttcctactcaactcttgtttttgttattatctctttactttttcaaaaaaaaaaaacacacttgagaggacattactcccagggtggaatacttcagtgaaccgtattttagtcctgcatagaactgctttttccttgtctatttttcctgtgggctacctacaaggatccagaaactcttcagatacactggtctactctttctctccccttcatagtacccccttcactggcccatggcaaagaagcctgtttagaatgctattactcttcagagggtgatccctgcctgggcattgttggggcactaagtagaaaatcagaatcaggccccactctagattttctgaaagagaatgtgcatttcaacaagctccccagggaccccataggcacagtaaagcttgaaaagcactgctcgttagagattaatttcagagcatcagctgtagtcaggtgctggccccaaggacctacaggtgactcctcagatggcttcctccagaacccactcctcagcacacactctctgagatcctccctgtgctggcatttgtggctcccaccactctagcttcccccaggaatgttttgggtgatgataacctctttgttgctcagtgtaattccctatttgctgcttagagattcatcaggatttctgatgtgctgatggtatgcttgcttttttccagtgatgcctggaattgtaatgactgtgtgtcttgttctcatttcagtgctatcccagaagggaggaaaagcaaattcaggcacagtctaccctcctgagtcccaattccctaagaaaaactatattatattaaaatacagacatttatatattcagtctaagagtgcagaacagtataggctaaaaggtaatcttaggtgcattcccaatcacacctcccaagggcagcttcttctaaagatttctcttttggttctggtgagcacctccataggtttagggaatgcctttatatctgcattttgcgggttttcagttttatcttctctctatgaaaagtaaggatttccctcacactttggccctccactccccagctcttcacaagtttgttatatgcttatttttagttcctttattggttacatttgtaactttaaataatatagctatgcatttcatatggtaacttttaaaaaatctagctaagtgccagtggctcatttctttagctcaaacacaacccctagacataagagcctacatcttgttctgacttgttccagtgtgggactggtggaagacattcaataaatattgcactgattgttttggacctgggcagaggaaggagctttgttattcatccacatacaagtggctaagagcatggactgtggagccacatagcctgggctggaattctggccgcttccctcactagctatcactgtgtacacattggttggcctctctacctgttgtagaatggggctaatgataaaactgaattttcagaaattaatgagttgatccatgtaaagcacctaaaagggtgcctggcataaaggaaacaacaaatgatatcactatttttattgttgttattatccataaaaacagttttttttaatttaatgtggttgttaaccagagatgtattacatagttacctgtggatctgtcagaatactcatgagtaggccccactctagaaattgtttcagaaagcctggggtaggcctggttatgtgcattttgagtgacactccagagggttctgatgcccatctttggttaagatccactacttgaaatatctgctgagaggaattgcaaggaaataggagacggcaatgagcatgcgagcaggatgggatgggaagacaggagcacattgactcactcctagacagctctccaaactcccagggttggaagcagaaaacagcagaaagcaacttgaatttctgccctatttctccatatttaaatctatttcaggaactatatttttccctctgtctcctggatgaaacctctggttggtcccataagttcactggtcattctgagataataaaaatcttctaggaactgttactttcaagagtagcctcattatagtaatgaaaactgtccagtctcatgtagtagtacaaactgaaatttatttcaagtttgttgatcttttcttagaagttttagctttgttaattttctctaccatttttctgttttattgatttctccttttacttttatttgctttttcctacttactttcagtttactttgctgttctttatctagcttctcccccgacattttattatgaaaatttttgtataaaacaagtaaaagaattgtaggttgaacacccatataatacgtccacctagatttataataactataaaaggcctaccccaggctttgctatatttatcccctgtccatctgccaattcctctgtccttccatcaattcgatttattttcttgtggtgcatttcaaaggaagttacagagatcagtacccttaacacctaagtacctccacaggcatatcattaattagagttccatatttgttagtactttatcattagtgctcatgaagtattttaataaaacaaaatgcccttatggcaccatatgatctttggccatacatgttaatgtttgaacataattttctatatgtgtttttatgtgtggtcattatatatttatgttgatgtgactgcattccttttattttttcaaatgaaattgattaaggtataatgtacataccatggaatttatctttcttaggtgtatagttgtatagttttgacaaatatatagctgtgtaactactactacaatcaaagcattggacattttcatcccctgcaaaaaactccgtgtttccttttataattcagtctttctcctcatcccaggcttgacctcttttccttctagtttggttctttctagaatatcatgtggctggcttctttcacttaccttaatgcattttaggttcatctatgttgtggcatgtatcagtttgttccttttgatagctgagtagtgttccagtttatctgtcgatggaccagttaatgcacatttgaattgtccctggggtttttttggttattatgagtgaagctggtgaacattcttgtacaggcatttctgtggatctgtgttttcatatctcttgggtaaatatctggagtgagattgcttagccatatggtaagcatatgtttaactttataagacattgggccgggtgtggtgcctcacgcctgtaatcccagcactttgggaggccaaggcgagcagattacttgagctcaggaatttgagaccagcctggccagcatatagtgaaaccccgtctctactaaaaatacaaaaattagctgggtgtggtggtgcacgcctgtaatcccagctacttgggaagctgagacaggaaaattgcttgaacccaggaggtggagattgcagtgagccaagatcacgccactctactccagcctgggtgacagagtaagaccctgtctctcaaaaataataataataataataagatattgccaaactgttttctagtgtggctgtactattttgttttcccaccaacaacacacctttctagtaggtatatagggggatctcattgtgatttaaatttgcatttctgtatgatcagtgatgttgagcatgttttcatgtgcttatttgccatctgtatatgttctgtggtgaagtgtctattgtaatcttttgccattgtttgttattaaactgtgagagttctttatatattgtggatataaatcctgaccagctatgtgttttacaagtatttactcctaggctgtggcttgttttgttcataacagtatcttttgaaaaacaaatgtttctgtttttataaagtccaatttattaaatttttcttttatggttcatgctttttgtgtcctctttagcaaatctctcaccaaccccgggtaacagagattttttctgtatgttttcttccaggagattcataattttagttcttatatttataagtctgtgactgttaatgacttaatttttgtatctgatgtgaggtaagggtcaacatatttttatattatttttacatatgcatttccaattgttccagtaatatttttgaaaagaatattctttctttttctcagatcaacaagtgatccgtttattatttgacatctactttaaaatgatgccaggtgtggtgcctcacacctataatcccagcactttgggaggctgaggcaggaggatcccttgagcccaggagatcaagaccagccagggcaacatagtgagaccccgtctatactaaaaaattagctgggcatggtggtgcgcacctgtagtcctagctacttgggaggctgaggcacaagaatcgcttgaacccaggaggcaggggttgcagtgagccaagaccgcactgctgtactccagcgctccagtactccagcctgggcaacagagcaagactctgtctcaaaaaaaaaatgttaatagtaagaatttcactggggaactaggatatataaaataatctaatgaaaattgaaaattaagaatttaatatatataaaaaacacaaaatttaaaaagcaacaacaaaaaaagaatttaatatatagacttaatagcagattaaccagagcagaagagaggttaagtaagaaagataagttactatcaaatattcagtctattctagactgttctttcttaattaacttactttggcatcctttttgaaaagtatttgaacatatgtgtcactctgtacaccaatacaggttgagtatccctaatccagaaatccaaaatcctaaatgctccaaaatccaaaacttcttgagcaccaacatggcatccaaaggaaatgctcattgaagcttttccaatttcatgttttcaggttaggctgctgaaccagtaaatatataatgtaaacattctggaaaccaacaaaatctgaaatccaaaacacttctggttccaagcattttggataaatgatacacaacctgtaccacatgtcttaattgctgtagccttatattatgtgtttaaatcaggtagtatgagtcctcttactttgttcttcctttttgtaatgttttaactagtctaggtccttggtattttcctagaaattttagaatcagcttgtcaatttttgcaaaaaagcctgcaggggattttgacattgcatggaatttgtggataattgatgtgcaatattgagccttctaaatcatgaatatggtatatccgtctatttcagttcttttaaattttatttcagtaatatttgatagttttgaatggataggtcttgcacatattttgtttaattttcccctgtgttttatgttcttacaaggtaatataaatggggtgtgtgtatgtacctagttgttttgtatttcattttcctattgctcattgctagtttatagaagtgtaattgatctttccatattggctttgtatcctggaacctttctaataagctcacatattagtgctagtagctcttttatagatggtttggtattttctacataaacaatcatgtagttatgaataaggacagtttatttcttttcccaggctagatgcctttacttctttttcttaccttattgtacttactggctaggatcttcagtataatgttgactagggtagggagggcaacatacttgccttgatcctgatcttaggacaaaagcatttactctcttaccattaggcataattttacttgcaggttttttcataatggcctgatataggttgaggatatttccttctaatcctgattttctgaaagttttttttattatgaatggatgttataaattatttttatggatcagttcctatgatggtgtttttttctcctttagaccattacttcctatgtaattattgatattattggatttgcatgtaccatttttttatttattttctgttcatccccccaaccaaacttctttttggttttttgttgttattttacttcaccattcttctctttggaatatttgactattttttaaattaaacattctgtattgagataatcatagattcccatgcccttgtaggaaataatacagacaaatctcgtgtattctacccagtttccactaatggtgacatcttgaaaaactatactacaaatcacaacaaggatattgacattgagaaagtcaagatacagaaaatttccattactacaaaggtccctcatactgctttgtatagctatacccattccttccctccccacccattcttaagccctggcaactactaatttgttctccatttctataattttgtcatttcaagaatattacataaatgaggtcatacagtatgatgctttatgggattagttcttttcactcagcatacttctcagttggattcatcctgttgtgagtacccagagtttcttcctttttgtcactaatattccaccaaatggatgtaccacagtttgtttagccattcaccatttgaagaacattcctgttttcaacttcattgatttctgctcttattatttcttttcttctgcttgatctttatttctaatatatgcattcagtgctataaatatccctctaattgctgtgtcccacaaattatgatatgttgcattttcatttaattcaaaatagtttcaaattccccttaagacttatttagaagtaagtatatctttaaatttccaaatatttggggttttccaagtatcttttttattgatttttgttgtaatactgttattgcacataatatgattttgtataaatttgtacaagtttgttttaagacccagaatatgttctatcttggtgaatgtttcatatgcacttgaaaagaatgtatattctgctgttgttggatgcagtgttctctgaatgtcaattaggtgaagttggttgatggtgctgttcagattatctatatccttgctggttttctgtctacttgttctatcaattattgagagaaagtgttgaagtctccaacaataattgtggatttgtctgtttctctttcagatgtatccatttttgcctcatgtattttgaagtgctgttattaggtacatacacttttaggattgttatttcttctcaaagaattgactgttttatcattttgtaatgtccctctttgtgccagaaaatccttcttgttctgaagtcattgtctgaaattaatgtaatttctccagctttcttttggttaggttttcatggtatatctccatccctttacacatctctctacagagagtttccttatacctctctctacccacccccaccctgccaatttcccctaatagtaacatcttgcattagtatggtacgtgtgttacaactggtgaatgaatacattattattaactaaagtcacatcttacattaaggttcactctttgtgttgttcagttctatgggttttgtcaaatgcataaaaatccaccattactgtttcatacagaatagtcttaccgccctaaaaatcccctgtgctttgctttttcatccctttttcactctctcctggcaagtactgatctttttactatctctatagttttgccttttctagaatgtcatatagttggaatcatatagtatgtagccttttcagactggcttctttcaaatagcaatatgcgtttaagtttcctccatgtccatggcttgatagcccatttctttttattgctgaataatattccattgtggatcactttgtttatccattcacctattgaaggacatcttggttgcttccagtttggggccattatgaatgaagctgctataaacatcacgtgcaggcttttctgtagacataagttttcaactcattgtggttcatttccttttgaagtttgtaattttttttttactgtgaactccttttcagtgagagttattttccatggaaattctgtgtaccctaagctatgaaagcatcactgcagaactatttggattgccactgctggggcccactggtttcactaatgcaggaacaatttataggtgaatttatcaacttcgggggttttgtattatacttcaaatgtccatttggaatgcactcctacatgtggtacaggactgtggttctgacttcttgtaagtaacccctgattcttcttaacattttcattagccagtgggtgacatctttctagttcctattttacacacagagatgtcctttgtgactcccagctttaagcaggtagctcaattctaattctctgcacatttgtgccctgtggcctagaattcacctcacactcatgattagagccttagtcccccaactgcaaagccacacagcttcaatttctgttcactccctcactttaaatttcttcttcatttttgtcacataataaatttattttctggtttgagcttggctgcatattaaattatttttgttaaatttgagccagcatttctctgtacttgcactcaggggaggtggtggtggtgggacatggggagggtccatccacatcagctcaagtcatgttgataggagttcactgcttgggcatttagggattaatgttattccataacattctagtggaaagacttaacaagtttgatgattcattcattttcttctagaagtctggcaagttgatgagcagatagatcactacaaggaaagccaagacaaacttccttggcaagctgcattcataggcaaggaaacactgaaggatgaaagcggtcaagaatccagaacatgtagaaaaagcatttatctgagcacagaatttgattctgtaaggcaaagactccctaaatattattcgtgggaaaaggcattcaaaacatcatttaaactttcttggtcaaaatggaagctatgtaagaaagaaagatgatggatgtaaagcatattggaaagtatgcttccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacataagaaaattcatatggagagagaccctataaatgcagtgtctgtgagaaagccttcagtaggaagtcaactctcattaaacatcagataattcatatgggagaaaccttatgaatgtaataaatgtgggaaatcttttagtgttaaatcaactctcattgtatgtcacagaacataaatgcataagttgcatgctattgtgaatagtgtgatgaaattttgcactgtcctgctctttcctgctcaggatgcaaatcagtgaatctttttttttttttttttgagacagagtcttgctctgtcatccaaactggagtgcagtggcacaatcttggctcactgcaacctccgcctcttgggttcaaccgattctcctgcctcaacctcccaaatagttgggattacaggcacatgccaccatacgcagctaatttgtatttttagtagagacagggtttcaccatgttggccagcctggtcttgaactcctgacctcaagtgatccgcctgcctcagcttcccaaagtgctgggattacaggcatgagccactgcacccggcttgaatcatccttttgtccagtattatatccatgctgtatatgctacccgcccactagtcccttagctgtctcagttgtcagattgactgtcatgggattgcagtgcttgcattaaagctacccttattgtataatgaccccaaagtgcaagagtagtgatgttggcaatttgcatacaccaaaaataagttataaagtgcttccttaaagtgaaatggttaaagttcttgacttaataaagaaaaaaaatgtatgctgaggttgttaagatttacagtaagaatgaatcttctatccaagaaattgtgaaggaggaaaaagaaacttgtgctagttttgctgtcacatctgaaactgcaaaagttgtggccacagtgcatcataagtgctaagacgaaaaagacattaaatttgcggatggaaggcgtgaatagaaatgggttctgacagcaatcaggttcggtactattcacagtttcaggcatccgctagggatcttggaacatatcccccatggataagggaggggtactgtaccttgtcatattgtgcattaaagaattcattgagtgtaatcatgtaagtctaacacacatttaaaaagctctcagatatcatttcgccttcggttgatgtaagaaaattcaaaagctactcaaatcattcaataaatgataaaattattta

SEQ ID NO: 11 - DNA, 5188 bp, Homo sapiens
gcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggtaagggggttcattaatcgccaaggcctcactcccttttttccatctctccccggactcacccgccaagggtgggttggaaaccgaaacgagtcagtgttgaaacgtgtctcatcctattcctgaagccagaatattctggccatgagtcattgtttccgcccatcttgattcttttggaaatggcagctcttgttcaaagaccggaaagggtgggatgtcaatttcaagtggggtcaacctgagttctgtaaatcccagtagcgattttcccgccgcgggtgggcaggcgaatcttgcgccggtttagacaaaggaggccgtgaggacctgcatgcttttctttctcaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggtaagtttgccttaaggatgaaaggggccttggagtggaagtagaatgaaggattttttttagagaggtggggatatctaaaggtttttatgacgcacggctgtttgcaggctctaactaaaggaccattgtttatttgatgttgatttaagtagtggatccttagagatagtggtatggcggtcttgaattgtatcaaaaatcttggttttctctaggcaattttttgttccaattcagttgaatactcttcagtggattcaaaccatgaaaaaataagtcaccaggggaggatagctgaaataattcctaaggcggtgcctgttttaatggagaagatatggggtggagcctgcgttttaaacaaacccagatctgatgcaggatgtacttaactacgttgagaaaaactgatctgcgcaattgaggcgttactgaaatattaggtggtggagatttgagaataagggttttcgtcttttacctcatgggaactctggaagtccttttgttaggataaatcctaataagaccaagatagtactgtaaaatgaagtttaattatcatgggtccccgcttaagaaactgaagaacttattttctttttttgccccggggtgaataataattggtttactattgctttagggggaaaccttagatattttaatttaccttctctctggatagtagtgttgtaagagagcagaaacccatacttgaaaatgtgcttttcttttttgttttctaggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttaggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaatacaggg

SEQ ID NO: 12 - DNA, 6932 bp, Homo sapiens
gtgacgcaagggcggggttgccggaagaagtggcgaagttacttttgagggtatttgagtagcggcggtgtgtcaggggctaaagaggaggacgaagaaaagcagagcaagggaacccaggtaggtgcacccgagagtggggagacgcaggaggagccccgaacccggggcttctcggcgctccccgcgtactccgctctgcccccttctctccttccatttcctcccctcggtaattcgcgcctcccgcggctgtttccagggcaacaggagtagttcactccgcgagaggccgtccacgagacccccgcgcgcagccatgagccccgccccccgctgttgcttggagaggggcgggacctggagagaggtgcgagggcggagcatgaatggaggaggcggggcggggcatgatgggaggtgatggggcgggacctgcagcgcggtgcgggggcggggcatgaagggaggaggcggggctgggggcggggcatgatgggaggagatgtggcggggcctggagcgaggttgtgggggtgcagtaggaagggaggaggcggggcgggggcggggcatgatgggaggggatggggacctggagcgaggttgtgggggtgaggcttggagggagggatgcatatggggcggggcaaggtgttgggaggcccatgatgggggctttaggggctgaacctggaaggttgagggcggagcatagtaggaggaggtggggtcagaatgagaaatagggatgcttggggcagaagtgaggtagagtcttaagaagaggaggtggggggaaactacatggcatggaggccgtgaaggcagagcatgattaaaggagaatgggccctacctagaaaaagcaggtggattggacctgagggggcggggcctacagcaggggcggggcttaagaccaagctgaaggctggcgtggaacagaagggggcaggtcttgttagaaggatggggagggtttgtaggctggcaggaaccagggttgtggctgagagtagggtctttggagagatggaaaaaaaagggaaagccctgtcaggacctgtaactgacctaacctaacccttcttagccccacaaggctctcaatcccctgtattctacaggctgctccgtgaccccaccatgtcctctcctaccacgagttccctggatacccccctgcctggtgagtgactctcttccccacccagcccttatcacacacgagcagaagctcactgtacctctcccggattccaccctcttccaggaaatggcccccctcagcctggcgccccttcttcttcacccactgtaaaggaggagggtccggagccgtggcccgggggtccggaccctgatgtcccaggcactgatgaggccagctcagcctgcagcacagactggggtgagacagggccctggagttgatgtgggggcttggggaggggtttaggaagggagaaagaaatagaaatgggaatgggaggccctgatctttgctttttgttcttgctttctccttaacatatacatctttctaaattgcaatttccctgaatgtgagcagcaactcctctctccctccatcctctggctctttgcctggggatctcctgtgggcccatctctctggttcctgtttctccttgtggctttctcatggcctctacctacccaccccagtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgtgagtgcagcgggagggggcggtgccggcctggccccccgcctagccctggggttctgctgaggcctgcatccccctacaggcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacggtactgccccctccacaaccttgagtgtgacggtcccaatggggtagagccagctgggccatcacccagggtgtgggagaatgaggctccagagggcaggggctttgggaagaggatcccccagggtgcaggcttggcctcaaggtggccacccagacttaggctcacaaagacctgggagtgaccctggtctcctgtgtcccagccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgaggtaatggtccatctgcccacaaggaaccccagagatagctccaggacagatgctgggagcagagttaaggaagaccagtgcttgccgttgtaggatgacattccacggcgaatagagtcttctatgagccaaggagagaaaggaaaaagggtctgaggctgagaaaattgaggatcaggctagaggcgctattgcagagaaaagttgccaaaaaggcttttcagaggagttagcatttgaatcaaagtagggataacatataagtattgagcacgtgctgtatgccaggctctattccaagtgttggcatatggggcaaagaacaaagcagatcaaaccccgtgccccaaaccttgtgctcacctggggaaagagtatcctaaggagatggggatgcagcatgtgcggaagcctgaagtggagaaagagctcgggctgtctcacgtgatggctgcacgctggtgtggctgagagaacaggggggaaggggacaagggataatcctggtgagattagacccccatttgggccaggaggggagggactagcagctgaagggtcacagggctcaagctccccctcccgctgccgcccttagatcatgctgctagagacagccaggcgctacaaccacgagacagagtgtatcaccttcttgaaggacttcacctacagcaaggacgacttccaccgtgcaggtagggcccaggggaggcttcggggaggcttggcgcccctgctggctggaagacctggggccaactcatccctgttggagtctctgtttctttatctccaaagttggggtgagggttgagccaaggtgagagtgaggtaagagtgcatgtgccacgtgtggtggtgcacgccaatagtcccagccactcgaggctgaggagggcagattgcttgaggctatagtgagccgtgattgtgcgacggcattccagcctggtgacagagaagaccgtgtctctattttttaaaaaaagcatgtattgagtgccgactctgtacattgggttgcagtggaagttgagatgggaggagccctgttaccacatcaggcatcttggtgggcattaggaaaagcattccccgcccccgccaaaacgtggtctcacccaagggaggcgggctggagctcggtccattgtgaagcgggcagccttctttactgtctaggggagcactgcttcctgccctctgagagcgctaacctgcgtgggtgggcttctggaagaaggcctgggcagtgagaggcactgcctaggaaaagggtgggaggagcattgctagtgctgcagagcatgcaccagggcctcgctccctcattgtcccacaatctctgggggacctctctgtatttcccgacatctgtccaaaccccaccctctccccttcctcttactccggccctttcaccacccgagacggtcccagtaacccttttagtatgagcttagcagggcagggctgcagggaagcgtttctggcagaggagattggcgattgcagaggccctgaggttggggagagctggtggtttggaggaactacagggaggcccaggcagctggagcacaaggagatggggtggagaggaggtcgggaatcccaccctaccccttcccagccgctcctctgccaccaccctggaacactgccagggtccccttgaggggccgcctgcctccacccctgcctgatggggctgctcacagcacaggcagaagggtcctgtcagcacttaaggctgcccacttccctcctccgctcagaaccctccgcggctcccgtctcactgggagaagagctagagtcctctctgtggcccacaaagccctttaggacctggcctcgctcactctctgccctcagctctcaccctctccccctgttccagccactctggcctcttactggcacccatccagcatgctgcagccaagggcctgtgtacttggagtttcctctgcccagaactagggggaccaactggtcctagtttgcccaggaccttcccagttttaacactgaaagtctcatggcctgggtagcccccgtcccaagtcatgggaacagcagacgttggtcaccctcacaatccctcatctccttcggattggtcactgctccagcgtcacccagagcgcagccttccctgcccgccttgtgtaaaatagaaccatggctcagcagggcccttcacacttctctgcactgcctggttccattgaactcacagccctctgacaggctgggcctcttcctaatgtgtttgtctatgaccggtcccctaggctctcaaatgtaagtgctggagcctggcacgtggcaggtactcagtgacatttgatgactgaatgaacaagtcagttttgggaatgagtttgggctttaccttgagcagtggaagccagcgctgggaccagcacgatgtgacctaggttttaaaagcttccctttgcctttgtgaaggggacaagaatagggactcgggaagctgcagccaccgcccaggtgggaagggagggtggtgataggatagtagaaaatactgaagaaacatgcaccctcattcattccttcactgggcagcatgtgtggcacacctactacatgccagcactcatgggcacggggcacaggtggacagaaatgacaagaacgctgtaattactgctgtgttcccagccccagagactgtgggcagcgccagggtccaggatgtggggcacggtttcgggctgagggagtcacgggctgcctcccgccccgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggtagggccccgcagagcctctgcgcagagccaactacgtcccgcggcccacgtggtccgttcaggctgggttctgccagccacactgccctcccctccgcagagtctttcctcaggccccaccctgctcgactgggagccaggtctagtccaagcacagaggcgggccccacgctggctcccacgcctggtcggggaggggccctcctttctgttggggtgggcctcccaaagcctggcagggcaggggctcagccagcgcccacctgcctcctccctcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccagggccttcctcttcctctgcttttatttaataaaaactaaaaacagaaacaggaaaataaaatatgaatacaatccagcccggagctggagtgcaagatggagagggcgcgggcttctagggacctcagtgacactgggtgcccgaacctgattgagcaggtgggactgggtgtccccaggctgttgggaaaagggtggcacatagggtcccagtgttgggtggtgtgtcgcctgctgtgaaagttcaggacagaggcctcagcctcagggtcacctccctggacaaggtgaatcagaactcacccttgaaggataaacaggatttaagtgaatgaggggacctggacttctgtccgaacaacaagtgtttgctgaggcctcctgtgggccaggcactgggttggccattctagagatggagacattcacccaataaatgtttccagagcattaa

SEQ ID NO: 13 - DNA, 18261 bp, Homo sapiens
cagtcgggctgaaagctccttccttgtcgctccccactgaacagatttttcttggggcggggagagggggacggagtatcgctgagtcgccaggctggagtgcaatggcgcgatctcggctcaccgcaacctccgcctcccgggttcaagcgattcttctgcctcatcctcccaagtagctgggacttccggcgcgcgccaccacgcccagctaatttttgtatttttagtagagccggggtttcaccttgttggccaggatggtcttgatctcctgacttcgtgatctgctcgcctcagcctcccaaagtgctgggaatacaggcgtgagccactgcgcccggtcagaacagttttaacctccagcaatgaccactgcttccttctgcctgcagttggaagtcagtttcagttttcttattccctataaggaacccacctctccggtcgcctaacacacagatgctgcccagaaaacgtgctggcgcacctgaggcggggtagaaagccgtgccgctcctcccggcaccgagcaccggagcccagggaggcggcctccgagtgtcatttggggacgtcccttctgccgggtagtctcagaggccaagcgctcctattatcccgggcgcagtctccccaggcgggacaggccctgcctggcgccccctcctggcgctggaggctgcgtgcgactgcccaccatcgaggcggcggcggcggcggctagagaggccggcgggtcccgggcgccgaggctgcaggccgcagggaacgcgcactgggcggactccgcgccgccggccttgtagccattttaggaggaatcgctggtcgccagcgaggggtgcggcttcaatttcaataactttattggtggcctgatctgcagaacagccatcacatcagtggcccttggaggagggagcgcatcgcccgaggtgactggagtgggggcgcccctggcagtgagcgcggggacgcgggggaggtcccgatagcgggtttcctgagctagggccagtgagggcaccggggtatttgcaggcgttcccgcaggccaggagggagagggctccagggctcggcttccctggggcggggaatcccttgccctgtcccgaggcgcaggggcggggccggggggcgcccctgacgcggcggctgaggtgttcccagcccggtgtcgttccccgcggtaggtggtccccgacgagctgcagccatgggaaacaccaccagcgaccgggtgtccggggagcgccacggcgccaaggctgcacgctccgagggcgcaggcggccatgccccggggaaggagcacaagatcatggtggggagtacggacgaccccagcgtgttcagcctccctgactccaaggtaagcgtcccatgcccgcagttggtgtcagtactgcagcgggttgatttctgggctcctcttccctttcttggttcttttctaccgcgccgaaccgggctatggttttttgaattaaagggatttatcggggacagaggtgttggatgataattcctcttgaagtgccgcctcaaaataggataaagaggcggagttcttgctttcctggtgttctgactaatctgttggccacatttttaggatggggacaatagacatccccccatccccgatcctccgagcacgaatggctctcttccatagcgttgctgaatttgtagtttgtaatccctggtggacaacttcagagggtaggttgcacgagttgctgaccataggtggtagtttctcacctttgccctgaggtggctaaatgaaattctttttctgaaaatttctatgtatcagtatcatttttgctcttctagcagctctacagttgtgatcctcttcccttttggcacggctgtaagcagcaactacttgcttattgaatactttctcctagtcttggggatcaattaaggacatcatttagttgactgcttaatttttgtcccatactttatagttgtggtggctgaggctgtgcctctttcacgccccgctgctgctccgtaggtggaagagccaatgattccacgacttgtttactcctcagtagtacttcaaaatgttgcgtggctaaaaaaacgacaacccacagctgccctgaagaccttgctctcaattccaaggactttcaggaagagaacaacttgttttcactctgtaagaaaggacagatggagctgatagcagcgattaccattctaatgtttctaatggctttcagagctgtcagcatgaaatacaagtaattcctccaggtagactgactggatgagatagaaaaatggagggcttgaggagattcgggtgtgtttgatgtttcctatcatttcatcacttcccagggaactggggctttagagagtgaatagagtattgtttgccatattggtagcacatggaatttggattccatgatttatttctttggatctcaattgataacatcatcacagcctggcgcagaggctcacgcctgtaatcccagcactttgggaggccgaggcggttggatcatttgaggtcaggtgttcgagaccagcctgaccaacatggtgaaaccccgtctctactaaaaatacagaaaaagtagccgggcatgctggtgcatgcctgtagtcccagctactcgggaggctgaggcaggagaatcgcttgaacccgggaggcggtggttgcagtgagtttagatcaaaccactgcactccagcctgggtgacagactctcaaaacaaaaaaacaaaaaaacaaaaaaaccaaccataatcacagagaagtgagagtgattaaaaggagcacttattggggtttattctccaattctccattcttatttgggctatctacaagccatctgaatttacttcttcaaagctttcgaaaggtgatccgcctcattatatttttacccttttcctatgttgatgactcaggatttaaatacagtgtatttgtcgaactgtgactgcagtaattggtgtcctgattaaaagccaggttgctctgtctgaattggggcctattttgtattattcttatctctcacctcagtcttggcatttgtgaattaagaaaattattcatataattttcagattgtctgaaaatcagataattcctaaggtctcatttaagtctaaaattttatagttctcaatgtagcctctttacttctaaactcaacattttacttaaacatcaaactgtagttctgattgtcgttttgcctcttttcctggtagttttgctgagtaacttggagtaaacaatctttctgctagtcagttgcattcattcctactacagaaatgtcatgtcataagtggaagggctttcctccaaagctaggcatattaatagtttgtagctttcaaattctaaactgaaaatcctgtcataaaagtaactgacagaaacagtggcaggggggcctactttgctttgaatgcctgcctttttcagtggactagttcagtggttctcaatcctgtttgcacattagaatcacctcagatttctttaaatagtttttggaaaatttgaaacactttcaaagtagggggaaacagtataatgacatctatatacatgccacccagtttgaacaatgatcatatcttgaatgaacatataacatctataccccagtccactattctcccactagttattttgaagcaaattcccagatattatatcaagtattattttatctgtaacattttaggatgtacctctaaagatgagggttttttctttgttattttaacataatcacggtatatctgggaagctttttttcctttattttaacataatcacagtgttatctagaaagctttttaaaaataggttcccagatcttacatccgaatctgagggttattcttaggcatatgtcaaattcttgtaattctaacgcagccagttagtcaagagtgcattgttctgagaatatgtagttttctcttaagtcaattccttatgtgaaagtcctttcaattctctttctctatttactttggattatcctgctactgatatgctatactgtagttttgaggaatatcaagagaatgtatggagggaagctatgtcaaccattttgaaaagaaagcccaaatgaataagctagtcctttttttaaaaaaaaacccacattattcaatttagtaatatttaggcttaatactatacagtcttatttaccaaagtcacttaaaccagtctaaaataggggtcagcaatctttctgtaaagggccagatagtaaatagtttagactttgtagaccatacagtctctgttatagctacgcaattctgccactgtagcctgtaagcagctatagacaatataggtaagcaaggcaggtatgttggttcacacctctagtctcagcttctctggaagctgaggtgggaagatggcttgagcccaggagttcgaggctgcagtgagctatgattacaccactcactgcattccagcctgggtgacagagcaaggtcctttctcaatcaatcaatcagtaaaataataggtaaacaaatgggcagagctgttttcaaataacacttgataaaagcatctggcttactggctgtctgccaactcttggtccaaaggatagtaatgaaaagaaacaggagttactgtttttacaatcccataaacctcatttgataagagagctacttttgataaaggaaattgtatttttgatctcttgcttcttgaggttctagaatttttattcctactcctgaaataattagtataagcctgggataggggaataagtaagatttcatagccacttctcaagttttaagaaatcagtgatctagtttttgaatttttaatgtttcttctttttacttcttagctgaaatacagtttatgaattacttatgaattttgatatctctgacttccattacaactggtaattgagagctattcatatttgcctataaaaatatatggctgacttaattatcttttacagaaccatactttgttttcatttttttttcctctgaagaaagactcagaagcatatcataattgcctgcctatgagttaaactagtggtagggagttatttttttcttttttttttaagggagagtctaaggctctggaagggtaagtgacacaggtagactcaaaagttaggctatgatttaggcagtgcttgagcataggccatttgaccatttttggtcctagatgagttctttttctataatttgttcaaactctgatttagttgctaattttggggtttatatccttagccaaagcctagcacccttctctatcctagggaggagagtgacctttttagaattcttgggtcacagtttattctagggatgacctactccttcttacagctccctggggacaaagagtttgtatcatggcagcaggatttggaggactccgtaaagcccacacagcaggcccggcccactgttatccgctggtctgaaggaggcaaggaggtcttcatctctgggtccttcaacaattggagcaccaagattccactgattaagaggtgacaagtgtcttggttgaatctaagggtccaggaatagagacctgatttcttttctcagaagagagacccagctggacttttctccacctactaaggactgtctctagaacatgcccttttctgcggccacttagtatatctgtgggatttttttttaacctcatagtgagtcagagatgttttaccctttagaatttcattgcctcagagggattcataatagctttatggctacattctttaggactatgtcatacaagtcctgtctatgcttgtgggaagtcttttgtaactgtctgagtcttgttgctctgacttctgcactaaagcaaaacacattttgaatttttaggtagtcatgttatttgttgcttccaaagcaataatgagtgatttaactggttgtcagaatggccctttgtatggtagttcattctctagaaaaggttcaccaaaacagggaaagagtaccttgaggcacttctgtatcctaaacctacctatcttatttgcactggtgaggaacttgttctactgaagcaaagtaagttatactaaggtgaaccatttgaggggattaatgtttttattattcttttccagatattggttaagaactaacgttgttgggaggagctggtaaatacatgtccaagatgatacagaaaaggagaatgggtttatacgttgttttttacaccaggggatacaatggcttaggaatctgggaaattattcatatgatactatgattgccacttgttttttagattcagtcttctaaaaggaacttggcctgtttgcctttcttttttcttctgtagccataatgactttgttgccatcctggacctccctgagggagagcaccaatacaagttctttgtggatggacagtgggttcatgatccatcagaggtaaggccttgatctccaagggtaaccattgacttagcagtctcattttagctgtcatttctgtcaagactgatgggcagctgctcccctacactggaggatttctctcttgataaaacgtggaggtgctgagaacaatcgtgtaaattttagtaaaagaggaaggttggatggaagagatggatttgaaagagagattcaataattttttctattcactgtttcagcctgtggttaccagtcagcttggcacaattaacaatttgatccatgtcaagaaatctgattttgaggtgttcgatgctttaaagttagattctatggaaagttctgagacatcttgtagaggtaattttgtattatttactctctcttgctgtgtctttcttgtagttccttcctaaaagttgtttatgtgtgtatatacatatagagggagagagagagcagggggttggggggaggagagagagagacagagatttttctcctgtaaacatttaggtctcttatttgcagcaaacacaaacacacacattgtaacacaagtctcatgatacaatgtttaccttattacatgggatacactctattttccatgttatcttttataatcactaatgggctacagcctatagtttgaaaagctgtttctagtaatatttcaagttttccactgacctttgatgatattacccagcagaggcgatacatgtgtgtagtttgtttggtttgccccatcttaatcctgccagtttgagacctcagttagcagtttcatgattttatgaggtccaaaaaatgtggggaaaaaaatggtttaaaaaaccaacagcctgggcaatatggcaagacccatctctacaaaaaatttttaaaaattagccgagcgtaatggcacatgcctgtggtcccaacaatttgggaggctgaggcgtgaggattgcttgagcccaggaggtcgaggctgctgtgaagcatgtttgagcctcctcactccagcctgggcagcagagtgagatactgcctcaaaaacaagacaaccacccccctgccccctgacaattctgttgtaggtaattgaaattttgtaaatttttggttaaaaaaaaaaaagtctatggtagcggaaaatatctttacacttttatttcctctaatattatttgagccaaggccttcatctctgcttacaattgctatagtatcagagaatattttgctaaccacacttgtagttaccattttgttactttacaataagaactatctaaagaattgtgcacagtattcccagtgagcacacttctctcctgtgagttcaaagcctgcctctgctactaactagttttgccatcatgaacaaatctctcaacctttttcgttctgagtttcttcacagtaaaaccagggacttaaactttcagtgattctcagctgaggaggcacaataccttaagtggaacatatttgaatttcaggggagaagggtggctttgctgtttttaaaagaaattattggctgggcacactggctcaggcctgtaatcccagcactttgggagaccgaggcgggtggatgacgaggtcaggagatcaagaccatcctggctaacacggtgaaacctcatctctactaaaaaatacgaaaaattagctgggtgtggtggcaggcgcctgtagtcccagctactcgggaggctgaggcaggagaatgacgtgaacccgggaggcggagcttgcagtgagctgagatctcgccactgcactccagcctgggcgacagagcgagactattattaatagtgtaatcatctgttgaggaaacttttgaaaatgttgttttcatcatataagctcagaaggttaaattgggcattatttttgactggtgggacagtaatttaaaagggttttaaaatgctgaattagattatgaggatacttgtgactaatttttgcattatataattctggcaaagtaaccaataaatagacatgtatcataattatatagagagaagacttgcatacttttgatatttccctttctcctaatttcccaatctattgaggtaacgcttataatccattttttactaggaatctacagataatggattttagtctgcactcatttactgtctatccatgtatgtaactttaggcaaataaccaatttgtatttatttttttctggtgaaaaggcaataaaaactattctgtgcacttcccaagggtattttgtggatcatgtgacgaaataacaaagcataatactttgtaaggtttcaagttccatatgttttaaagatattatttaatatcagagtattacttctgcttttttcttttgccttatatgtattttttatttttaattgacacataacaattgtacatatttatgagatacaatgtgatgtttcaatacattttatatgtgtaatgatcgagtcagggcaattagcatattcatctcaaacatttgtcgtttcttcgtggtgataacattcaaaatcctttcttctagctattttattttgttacattattgttacctatattcactctactgtgcaacggaacactggaacttagttcttacaatgaatttggtggctcacacctgtaatcctagcactttgggaggccgaagtgggaggatcacttgagtccaggagtttgagaccagcctgggcaacatagtgagaccctgtctctacaaaaaaaatcaaaaaattagctgggcatggtagcatgtgcctttagtaccaactactctgaaggctgaggtgggaggatcacttgagcccaggaggtcaaggctgtagtgagccgtgatcaagccactgcactccagactcggtgacacagagcaagaccctctctcaaaaaagaaacaataacatttaaataaaatatattataatatatttctcttcatttttgtatattgtattcttgtctgcatactttttttcatttttttgagatgtaatttatacatcataaaattaactcttaaattgtacaactcagtaatttttagtatattcagagttatgtgattatcacaactatctaattccagagcatttttatcacccgcagaataaaccctgtacccattagcagtcacatcccattccctcctcccctccgtccctggcaaccacaagtcttgctgtcttaaggatttgcctgttctggacatttcatatcagtggaatcctacaatatgtggtcttttgtgactggcgtctttcacttagcataatgttttcagggttcatccatgttctaaccatgtatcagtacttcgctcttttttatggctgaataagagcccattgtgtggacatactgtttgtttatccattcagtagttgatagacatcttgattgtttccactttttggctattataaataatgctattatgaacactggtgtacaagtttttgtgtagacatatgttttcatttcttttgggtatatacccagtgtataatgctgggtcatgtggtaactttatgtttaactatttgaggaactgccaaactgttttccaaagtggctggactactttacattccctctagcagtgggaatagtgtgagcgttccaatttctccattcctttgttgacacttattactgtctgtctgtttgattttagctgtcctagtgagtatgaaatggtagcttattgtggttttgatttgcatttccctaatgacagttacatacattttgtccttattgttgcaatcattgttgtattggtagtcttaggagtttataaccttgttgtttggctggaaaaaagaaaaaatctaatcttttcccattgtttgaaagttacaaggcatctttacatccattatctaatttgatttccttaaaaacatcatgaaatagggcaaagattatttttattttataaagaaactgaccattgtggagggattcttccaaggtcctacagctgatacatgtagtagctcttccctgagcctgggtctttgagtctttatatctttgtctgtctcccaaatcatgttgctatgttgaggagcttcatggtttatgtccaggggactcagatttttcctctggttaccttacagctgtagatcccacaggtcacaagtttgtgatccaggacttctaccatatttaatgttagctgccatgtattgatagctttttccatgcattcttgctaattctccaactctttctcatatttgtataaatatctttcagacctttccagctcacccccagggccttatggtcaagaaatgtatgcgtttcgatctgaggaaagattcaaatccccacccatccttcctcctcatctacttcaagttattcttaacaaagacactaatatttctgtgagtatcctgagtattactggggcatctgggggtgtctaggaccatttggaccaaagttcagtaatcctagaggttaggattactacagaggtgtgttgagattataagtcatacacataccaataacattacagatttcctttttccagtggtgagtcacagctttttcaggtactgatataaaaattcatagttgtctcctcatcctaataaaatcaggatcagagctatggacttcttttgagcacaacataaaggagtagttatcatttgggggtgtacaaaagaactatgaaagcttttttgtatataattcatgtctctattcaatctacttgattcctactatgattgtttttgccttgtaacacaactcttccttgtgtgttgtgggcaagatttttgttttagctctcttaaggaagattagtagatgctgaggcatgagatttctgccctggactgataatttttctaattttctgtaataggattgtattattgatacatactagagtgggtgcattattgaaaagagatagcgcattctagtttaaatttctcaaagagctctgaggaagagtaagctgtttggtttgtctgtgcattaatttcatttagtaatttttttagtaatttttttctctttctcttagtgtgacccagccttactccctgagcccaaccatgttatgctgaaccatctctatgcattgtccattaaggtaagtggtggccctggctcttcacagagctccctggaatgagaggtcaagggtaacatacgttctcagtggttactttctctgctatttcattgaagctgaagctggcagtaatgatcaaattatagaagaactctcttttttttaactactaggttgtttgttttaaaatctcagtctctgtgttctggctggctgaattgccctctgataggacttttttgctgcccagttattttttgggtgactagaatctttacactaactgtttacttaagtttgtgttcatagcataggatttcttctgcagaaaaagcaggtttagcttccagttcaaagaatgcttgaatgtgatattaaggctttcattttttgaaggtggaattgagctactttcaggtgcctcattcatatatactcaggtgcttgcatctctcctatacactagttaaaggagagatgtgaccagatttgccctgtcccgtcaactctagagtcctccttggtttttctgctgctttagagtctgggttggaaatagccattctgttctgtcttgttatgtctttgtggtttggctattggaataaagttatatagctctgcagttatcaaaccaggctgattatcattagagtctcctggagaagattgtaaaaatacagattcagcagctccattcctagagattctgaataagtgcatctaggatgggccctataatttttttaagctgcttttacttggatatatagctggattcgggaaatcactgatatagctaacaaactatgtggtacaatataacacttaaaaatatattattgaatttaatttttataataacgttgtaagtatttttaactcctgttttatagataaagaaactaaggctcagagaaggtcaaattgccagtaagtaccagagacaggactgctgaggtccagtcctcctatgctgacttcatattctttcctatattatcattatgccaggtctttccaagtaggtttttctcaggtattcctcatttccacaaaacctgtggaagtgtaaaagtgaattgtttacctgccttgcttctgtcgtatttaggctttgtgtcagcatgactctggagtgttaacccgagaagcattcatggtggataatacagtacgggggaaggtagaaggatacacttgttcttaatcggatttgcttgggttctttgggatctgatggattttgcctcctgtaactgctccttggatgtcatttaatttgcctaggcttgccatctcctcctgtggtacatctgtagtctacaacacagcctgggaaatggtacctcttgctgtcttcttactggttctgactcaggtgaaggtgtttgattattgtggcttagcttggttctgacccattcctgattctctcatattgtttaggcagtttggaattgatccattggattgggtgtctttctgaagaggattttgacatctactttgttcaaggatagagagggattcctaggttccctctaaatcagagagatcttttggaagtcatccctggttttaaatgaaaattagacctgctttgggacttggaaatagtttttcagaaggattgtttctttttttcctcattgtctttaagactttcttctagaaatggatgccagaatattttgttcttttttgtttttcttgctagttttaggcccaacattagaatttaaagtagggaagggagcaaggtaggagactattatttcttcagcccttttatgtgtcagaaactgtgtcagatattctcatgtaatcatcagagcaaccttaatggtaggtgttatcttttgtaatgatgagataaaaagacttggacacactaagtagattacccaaggccacaagtagaatgatgataggagtcagaattggaactaaaacttatttgacctcctgctcttatatcaaactatctctgttaaaagtgagtgactgtgaaggactgatgactgggaagagctacctactgtctgaagtaatgaattagctgcgtatgtttcttttccttgcaggacagtgtgatggtccttagcgcaacccatcgctacaagaagaagtatgttactactctgctatacaagcccatttgaagggatcccttcttgcctctaaggattcaggagaagcatctcccttgcatttctggactgaaccagtcttacctgagactggaaggctgatttgctttgaggctgatatgtgtgtttcagagcctctgagtaggatgctctgcttttgcatttgattgcagatgagagctttatgagttcacggaatttattttaagaaaaaaaaatatacatatgagaagaaggtaaatggaagcctcctagccccagctagaagtattgtttctgcctgtgggttttcaccaagacctgtttgggggcgctgcaggaataactatataggaagatttttcctaaaatgaaagaacagcaaactcttaggatccttgttgggtggagattctatcactgctaccttggctctccaaggaatgggcttgtgctagaccgctgccctacttaacagctgcctcattgcaagggcagtttttcttgcatgggttctctatattcccagagtatgtggcacaatctgtgttgtttatatgataccagatgccccacaagaacccttattcctctcatttcacattcttcctttaatagcctccttcagatcccatacctgacccctctctaacacaaaacttattgggtaagtgactttgaaaagttttgtggcacctgacccaccccagacactagggctatcagaaggtctcctttttagcccagcacaggcccaggccactttgtcgtgtttgttttaacttctaaagaaaatatgtttcagcattataagaaaggcagaatgcagaacacctacatttttgttttagtttggtgccaaggctcaggctgtattggcaaattcccgaaagttttcccactttgcctggccctgcttctgtcttttctttctcagtaaacagttctgaaggcaggagtggaacccgggagtattttcatgtctttcatccttgaaagatttttatgtgcctgcattttttttttaattaaaaaatgccttttcattggtcttaagagaccgcattggagaatttcaggcttttgataaatgcttcttcaaagagattttcttctctagtctagccttccacattcttagattaatatggccaaccctgtacacatcactacactaaacactgctctagataaactgctcaagttcatttaactcatttgatgcacctaaaggggttcctcattttaaagatttgttaggccaagaagcaagagagtattcctagtattcccaaccatgaaaagtatcattctttgcaccaaatgttaacaaaatcattttgttctcctgcctcttctttttaaaggtgtttgatgattaagtggggtcactgaattccatttgtggactgaaaagtattcaatccacttttggggttcagagataaaacattttttcccaagtagctggggctcttccattttgcagataagtcaaataatcaacactaaaggaggctaaactgttgatgaatgagagactccctgactgctcagatgaccctagccacactgaaagggcacctacaggtcagtttagctacctcctgtctttcccatgcaaagctgataacacagttgtctttggacttgtagacctcttggattccaggtgtgatggagtaaagtgtgggattgttgttttgctgggatgcaaataactaaatgctttggtggttaattgctaagagtaaatactactttagccatccaaggccaccttctgcagcaaaaggcttttgtggagaaccttttatgttcccaaccactttttgaatggtgtgccatttaaaaatccaggccagatcctattataaccaactctcaggatttacagccttcagttgtactagaattttgtttttatccaatactcattaaataagtgggccacttaggaagattcaaaatcttggttattacatgaagtttgttatatttcttgtcaacagtattgaaatgtaatatgtatgtgttcatgtatgaaaatttttactccacacaggtgtttcagtagagtggggcaggaaaagagatctcttcgatttctttcaggcctgaggcttttgtgaaatgcgtcagccccctgtgacagtaggttttgatgctagtgatcttcagatctttctctctggaaatgtgcagagagtgtcagtttcccaagttctgaggtaactctcagcccagatgtgaaatgggagcctaccagctggtatagaagggaatgggtaggaggcactgggtgctgactcattcagcactgtcccttttctatactgctgatacatcccatggttctgagaagccttatctcagtctatttggaagagagggaggaagagaaggaagtaacccaaagtactactcatttatcattgtatattgattagttaaagggataattaatttaatgctgaggagagtttgacagattttgaaaatgagtaaaggcaaaaaaaatttttttagcctttattttgcttttgggaattttacagagtcaaagtaggcagaataagaaaatagttcttcaggagggccgacctttaaagaacttcaacatagtttcggaattgtggggaagagaagagtgactgagctgagaagtaataatagaataaagggttgagtaacttacaactgaaaatgatctcttttaaaaagaaattaaatcagacaccacatggtggtgtccttggatctcactgtacagaattagcagtgtataaccatcttctcttttcatcttgttccaattctctcctctttcctttccattctgctttaagctcatgtgtcaggcagactttaccagagtgtcagacattacctaaaacacatacgttagccatgctgctggtatggagaaattccacaccatgattattagcctcctttaagctgaatgggatttaaccattctaggcaacacccctgaagggcatacctaacctcaatagtgttggcttttaaaacgtatgtttgtatggtagagaaactttgtaaaagaagaatccaagagaagtttgtgaggatcctacaaacccaggcccactcactttgctctaattctttctagtatcttgtagatctaatgggtctgggataaaaactttgaaaagtgtcaatattccatgtatgctgctgaaatgaagttaagtttggaaagaagtgatacctctagactgggtttatattaatctgggatataaatgaagaagacatactaatagaactccttgcttttaattggggaaatagggctttaataattttgacctcaactaaaaatgatatgcaatagtctctgtgtgtgtttgaaatacattgtgttctcagagatttctacattctcacgttctagtgatttggggcatgggcttaatagcagatgtacagtgtattcctgcattattgtgattccccttaaagcccagttcttgctgtcttctaccaggggctgctgactccagttacccatggaatgcaggacctgggaggggtagccattagggtctttcaaaactctttggatctaagcatttgtctctccttaagtgccaatcacaattggatatggaaggactgtgatttctgcaatgaacccaaacttttagagtaaaaagccaaatttaaattataagaaagaagggaaaaaagagaaaaactcaagtctattacttgtagagtccaattcttagcaatggaatcgctctaggattctagtttgggctttgtctggatttgcttttctcagttgtgctttgaagtgaataagctttgttacaaattaattttttattagttccaatattagttggagttaacttgaattgattgtatgtagcacagcacttttgcagtaagattggtgtgaaatactaaacactatggattttgtaggtgtcaggttaaatggtcaagggatacctacattaagtcatatattaggtattgatgatcttacttcttttctgttcccctgtacaaaacacttacctaacccagcttgtggttttaggacagccaaagctcactgttgttggttagtcctaatcactacacgggtctcataaatgagacttgtttgaattttggtacattggagcatgttggttggtattacacggcagcatttcgaatgagtgcagctctgtgtctgtcagaaaggagagataagactactttgaagggaattaaatatgtgagtcctctttttaatggtgctttttgtaacctttaatgctgaggtacagagctgcttttcaatatttcataaaggagtggcagacaagagtggattttaaagctgttcttcaaacgtaatttgtcactggactctgacacacctggaaattatatgatatgatacatacagaaatgttgtgggttttttccataaaactttaataaaagtattatacagcaataa

SEQ ID NO: 14 - DNA, 8646 bp, Homo sapiens
tggcgtcgccgtcgtgacgtatttttcctatgcccggtccgtgcattctggttgtgaaggctgagttctagagatcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcaggtgagtgggggcatccctcaagcgcaccccggcctggttggtgtgtcctgggatgttcgctctcatcgcgcacttcagggtgctcactccgtcgcattatgtggaggggttccgctcccctcatcagtggcataaggtgtggaacggactcgaaggcgcaggggcagttcgtacaaatgcatgcatggagaggagaatgagtttggggagttccgggaactctctgtgcctggtgagaacagggactagggggtcagaggtaggcctggaatggccgcccgaggagctggtcctctcttctgagggtgctgggagtcatgcaaggtttggtacagagaagggaggtcctctgacgcagttcttaaaaggctccctctggctgcagagtgggtagactagggattatagggtagacggggagatcaagatgaagtctactgaaatagtccaggtgagcgttgatggtctgggccagagtggtggcagcagaggttagagaatgtatgggttttgggttttgtatgtattttataaggaaggctgaccagattctctgatgagacatagtgatgatatcctgggattcttcacatgactgtcttcacttgagacagggggcagtgaatggaggtcatttctagtttagtgtcctgaatccaggccatgagttgtatggagttatgtggagaagtccccacctggcgaccaatgggatgagtactgcaaaagtatatcagacctaggaacaggtacgctcaaatgcttgtaggattgagtttggagcgctcagggaatctcaggtcttaattacctttgttggaaacaggtatcagaggaaggagttaggcaggaatggctggccgaggtgtcttgagtgtggtaaaagtcgtgggagatttggagcagaggagggagatgatctgactcagattttaacatgctctctctggctttcaggttgagaacagactgtgagcatgagggagcagctactgcagtagtgttgatggtgtctggtctagaggtgtggctgtggaggtgagagaagttggtaaattttctgttttttaaagtagggtgattggattttttgatgcgaaaggtgaaagagaggagagtcgtggatgaccctaaggttggtttgtttttgctgtagctggtaaaattatgaaaatgccatcaactgagatagagaagttggcagcaggtatgatttttagtggttatatcaggagttaggctttggtcatgtttaggttaagaggtctcagttgtcatcttagttgaggcctcaggaaaacacacaggtttttagttctggggaagggttctgttgaagaagttgaaaaaaatggtggccagtgtgtggagtgggatggggtatcttcaaatcatggtggtaatgctgttattcagtaagaaagttgaaactggacactgagagaaaactgggtctgttgcttaggcacctggacggcagtggtggatagtgtgaagacgcgagcgcttcctggacactgcttgcagagtggcatgggggatgagggatgtcatggaggtgcatatggcatgggccagtggcggtggggatctcagatgtgaggaaggtgtagtccaaagagtaatgagcacgttgggaggagtgtgaactgatgcccttaagactctagtattggcagctcatgggagaagatggagctgaagtttggttgtgtttagaggcatcgtctggacaacaccaggagaactggttggtaggcgagtatttgggacccttcatgccagacccagagttgagacagcatctgtctgcacacttgcctggttctgctctgggctggacacagtggtgagagggacatgaggagagagcagacactagtggtgccaaggtctgttatctcctcttagttgggaggctggggaggcgagggactagagagtgggtgtgtgagtgtgtagactggggaggagggggttctggggagagatgctgactgtggactcagctgtacttatcatggcagagttgtgtgaccttcgaggatgtgttcgtgtacttctctcgggaggagtgggaactccttgaggaggcacagagattcctgtaccgtgatgtgatgctggagaactttgcacttgtggctacactaggtaagtctgtgttttagttatctaatgctacatggcaaattatcccaaagcttagtaactgcaaacaataaaaatcaattatctctccagtttcagtgcattggtaatctggttagagcattttttgttgtttattattttgagggttttttttttgttttttgttttttgttttttcagagagtcttactctgtcacccaggctacagtgcagtgttgtgatcatggttcactgcagcctcaaattcttgggctcaagtgatcccccccacctcaccctcctgagtagctgggactataggtgcatgccaccacgcccggctattttactttttgtagagataaggtcttgctacgttgcccaggctggtctagagctcctgacctcaagcgatccttcctccttggcctcccaaagtgctgggattacaggcttgagccagtgtgcccagcctgatcacaccttcttatgcaggtgcttttggctctcatgaagttttaatcaagctctcagccagtgttgtggtcttacctgagaagaatccacttacaagctcactcacattgctttttgcaagatttagtttcttgtggcttgttggactgtgagcactgttccttgctggctgttggccaaagtcctccctcaggtggcctgtctgtattgtaccttatgacacagaagctaacttctctttgagcaagtgaccaaaagaatgttcaagatggaagcccaggattgtaacctaatcttgaaagtgtcatttcattatttttgccatattctattccttggaaataagtaagtccatccagcttacaatcaagtgaggaggcttacacaggggcaagagtaccaagaggtagggatcactgggaccatctcagaggctgtgttccacaggcctttacacccactccggtgtccttggtggggtttgagtcttcttctcttccccatgggccactctttctgtccatccagatccatgactcttctccttcccttctttgtttcccagagtaggtgctgtgggttctagggctggctgtgttcagtgtttctgccttcactgggtaatctgaacatctgttgccctagagctttgcaggaaaaggttaggattcgggagtttttcagtctgctaagcagattctacacagctcaggtgcccactgcctgagtccgtgtcatgatctttgcacctctttgtcctagattctgccctcatcctctggctgacatttcctggggcctgactgtgccaggaatttcaggggctgacacagtcacttcttgtggtgattacagggctgtcctggtacatccgccttggagagtattttttctaaacattctattttctctgtggagtgggtctacctgcgccactcacctgccctttgtttgcgttacagctttcattttcccagtcccatgcagttgcgcagttggagggggcagaaaaccttgggtgcctgacagggcagacatcactgcagccacagtaaaggagacctacagagggcatggccctgctgaatgggagctggaagagggtatctgttatggttgggttcaaatcgaaccttcaacttgttttgtgtttgtcagtgttttgttgccaaggcccatagtgattcttcacatctactttactttcctcattcttggcactttttccatttgtcatttctcacgtgtcttccatcctttgggtgttttcccacttttctggcctccgtgtttcaattgctctcttcaacactagcttactttaatgtgtcatgagttctgcacattaaatagtccgtgagaatgagctacttatttggagtcagattttcgtgggcatggacatacccatctgcacagagctcacctgacaccagcggccaaggccctgctgaaactctcttgcagaggaatcaggtagaggcttcacctatactccctatactctatgccattgtttttaggtctttacctcatagtcagggttcctccattctgtgaggccctatactgacaaccagcccttctttacactgatcctggccctcttgtcctgccaacaagccagtggactcgcactggtgttagacacacatttgtgatggggctgctgcctcccaccaaagtcagcatgcacttcaccagctcttttttgctttcaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggcatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgcgtagtatttcagtatttcattgtataccacaatttttcttctttgtcaacttaattgttatggatgtttgggtaactttcagtttttggctattacaaataaacctctgaagatttgtgtgcaaa

SEQ ID NO: 15 - DNA, 13648 bp, Homo sapiens
gggcgggacttccgccgtcctcctggtggtggtcgttttggttctgtgtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgaggtgggtgtcccgtcccaggctcccccgcccgaccggtcctcccagtgctgaagccccctgaaggggccctgcaggtcaggccccttgtcccgaagagaggggcgttcctgtgtggggtccccgtatcagccgatttgatgcagcctcagagctcccgttagggacctcaggttcagagcatggaggcgctgccgagtgggctgtgttggggcgtcaggggtgtgtgttgtttctgcgggaaagagagggttttgtgaattctcgcttggaatggcaacctgagcagccagtaaccatggaaggttgtcaagggagggacagttggagggggcaggtccagagttcgaagtttcaagttaggaaaaccaggttaggaatggacacagggagacgcgaaaaggccctgaggccactgcagtagacccaggagaattatggttggggctggaccagtgacagtagagggagatgtgatgagattcttcataggcctgaaagatagggcccgtaggttttcctggtgcttcagttatgtctgaacaaaggcagtgaagaaccgtttcaagtgtttgttttgttttttgttttctgtttgaacgtttggaagaatggagttggggaagtcagcataaagagcagatttccgggagaagatcacaggttggattttggacatggtgattctcaaatgtctcaagatggatatgtcacacagacaggtggacataaaggtgtggagtctgaggaaggggattgggttggcgataccagacggatggagggcttggactgggccagagaatggtctgaggatcagattgagtaggtcggtctcgggttttttttgtttgtttgtttgcataaatttaaggagtcaagtgcagttttgttatatggatatatttgcatagtggtcaagtctgggcttttaatgtatccatcgcctgaataatgtacattgtatccattaagtaatttttcatcactcatcttcgtctcatccttctacctgtttggagtctccaatgtttgtcattccacactctttgtccatgtgtacacattattcagcttccacttgtaagtgagaacatttggtatttgactttctgtttctgagttgtttcatttaataatggcctccagttccatccacattgctgtaaaagacatagtttcatgcttttttttttttttgtggcctagtggtattaccttgtgtatatatatgccacattttctttacccagtcatacattgatggataattggttaattccctatctttgctattgtgaatagtgctgtgataaaaatacatgttttttttaatgtaatgatttattttcctttgggtagatgcccagtagtggaattggtggatttaatggcagttctattttcagttatttgaaaaatcttcatactgttttccattgaggttgtacttatttacattctcaccaacagtgtgtaacctttttctcttctccatatcctgggcaacatcagttgttttttgacatttaaatgatagccattctgactggtgtaaggagatactgtggttttaatttgaatttgtctgatgattaatgatgttgagcatttttttatatgcctgcttgcgatttatgtgtcttctttttgaaaaatgtctgccctgtgcttactgttttttttttttttttttttttgaaatggagtctcgctccgtcgcccaggctggagtgcagtggcgcgatctcggctcactgcaacctccacctcccaggttagttcaagcaattctgctgcctcagcctcccaagtagctgggattacaggtgcccaccaccacgcccagctaattttttgtatttttagtagagacggggtttcaccatgttggccaggctggtcttgaactcctgacctcaggtgatccacctgcctcggcctcccaaagtgctgggattacaggtgtgagccaccgcgcccagccctgtgcttactgttaatgagattttttgttgttgtttttttgttatgttttgtttgtttgttgttgagttctttgtaaattctggatattagtaccctgtcagatgcatagtttgcaaatatttcatcccatttttcaggttgtacatttacttggttgattagtccttttgctatacagaagctgtttagtttaattaggtcctgtctacttttgtttatgttgtttatgcttttgaagtcttattcatgaatttttttgcctagaccaatgtccagaaggggtttccctgagttttcctttagtattcttcgttcaggtcttacatttaaatctttaattcatcttgagttgatttttgtatatggcaagagaaattggtccagattcattctttttcatatggcaatccagttttcccagcacattttattgaaaagtgtgtcctttccgtagtgtgcatatttgttgcctttctcaaagatcagttggctatagatatgtggctttatttctaggaactttgttctgttccattgatctatgtgtctatttctgcagtcaaatgctttaccactgagctgtacaccttatgtgtctatttctatccattaccatgctgttttggttactaacaacttgtagtataatttgaagtcagatggacttaatttgagggaaatcttgaggttgtcatttcaggtgggctctgtgttgagagaacagggggctgagacttgggggccagaccattggtggctccacagacatcatactctgtccagaacggtgcagacctggcataacagggattctggattgcatctgtaaaaagggaggcctggactgggtaagcatatggcctgggatggaggctgaagtgtgaggtggtttcgatcctgcacctgcaggcttggttgaccctcagggccactctctgttgaacaagagaaatgttattgaggctggtggagtagctgggttccagatcagagcactgctttttccccttctctacatgtcagggctacaggggatgatctactgctccagccaaggtctcctggcaagctcactttagaagattatgtagcaggtagacctggttgcagaaaggaccagtacctgacctgcctactcttcccttctctataactcattaacttaataatgtatgaaacacttattgatttaaaccccaattagacagtatctttctaagtgtgtgcaaacagataggcagttaatagtgaagtcattatgttaaatttctaaaagtgagccgggtgtggtggctcacacctgtaatcccagcactttgggaggccgaggtgggtggatcacctgtggtcgggagttcgagaccagcctgaccaacatggagaaaccctgtctctactaaaaatacaaaattagccgggtgtggtggcgcatgcctgtaatcccagcttctcaggaggctgaggcaggcgaattgcttgaaaacaggaggcggaggttgcagtgagccaagaccacgccattgcactccagcctgggcaagaagagcaaaactctgtctcacaatagaggagaggagaggggaggggaggggagggcagaggaggggaggggggagggcaggggaggggaggggagaaagtggttcataattggtttgatgttaatttatctcgtttgctttccttggaaaaagttaatatcgcatcctctaaaatcttaagctaaaaacatacatgaaaatttcaaaaccccactctttcatttgcattgaactcatgtacaaaaccattaatcttggaccatagccgctgatatatatagtacatgctactgatgtttgatactaatatgagccctgtgagggggcagctattcttgcaatctatttacagatggagacactgaagctcaggtgggtttggttcttttccatggtcacagagctgcagcactgaggcctgaggaactttattcaatgaattgagatcagtttgctcccaggcagggcagacgaggtggtggtccatctcagcctgaaggatccttccatggctgtcaatttctcacggcctttctcttccctcagggtcccctggcgatggcagaaatggaccctacacaggtgagtagagtgtttcctactattcacccaccctggttatctcccagatggttttggcaggtgacaaaacctcttttcctgtctttctcttatgtctgaagggtgagtggtttcaccagttagtttcagtattacaagttggctgctgggttacatagactggtccccgtttttgagaattgatctgataagatatgtttgggcctcttgggcacaggattcagaatgtttcaatgtttggaggagagactgagctaggtttttagggaactgcaaatgtctgttacatctggtaggaatacggagcagaatgggaggtggctagaggcacacaaacatcaggcctggaatgacagcctaggtcctgggtctgtaatctaagggaagtgggagacggggaagatttgaagcaaaataggtagtgataggaccccagtttaagagactttctttggcttctgagtggaggacagactgtggaggtgagggtaatggaagggagatctgagaggatgttcctgcagcagtctaggtggatgttggtggtggcttgtcaagagtggtcatagcttcagttttaactagagctgcccacattttatgatacagagagtgaggcagctggggaggtgggatagaaggggaatcaggagtggccccatggtttttgtttggaagcatagatgctccatcagctaagatgggagaagtcagcagtattaggaattttcagagtgagtgtgaggagtcagtgtttgttcaagccacagatgtctcagagactcctgatggaggagttcaggttggagatgtccacactatggtggctgtcgtatggaccaggatgaagccatggattcagtttaggtgacagcatctctaggttatggtggcagtgctgttcgaagacagagaattggaatggggcatgagaactgggtctcttactgggtagctgtgcagtggtggaggagtcactagacaaatgagggaatggagtgtttgtggggatgagtgtatgtgagatggtggggtataggagtgagaaagacttctgaaggagagtggacatgatggggttgctgaggggggataatagggtgaggtcggagagttgctaactatcagttgggaggaggtgaggatgggagttgtattaatccgtttccatactgctgtaaagaactacctgagactgggtaatttatgaagaaaagaggtttaaccaactcacagttcttcaggcttaacaggaagcataactgggaggcctcaggaaacacaatcctggcggaaggtgaaggggaagcgaggcacatcttcccatgatggagcaggagagagggagagaatgaagggggaagagccaaacacttttaaacaaccagatctcgtgagaacttactattatgagaaaggcaaggggaaaatatgccctcatgatccagtcacatcccaccaggtccctcccctgacacgtggggattacaatttgacatgagatttgggtggggacacagagccaaaccatatcaggagtggaaatatggaggtcagtgcagctgggcttggaatgaggttttggtggagagcaattttcctgactgtttatgggacagagtgtaccatgaggcaggacacagctgagagtatgggaagtcctcacatggtttgggcagctgacagtgaagtgagaaacagggccgtgtagggaaccttcaacccagggcttagggctgcccccggtgctaggggactttggtgttctggggcaggactgggaatgaattggatgctgagcgtatttgccgtgcaccacctggtttccgtgtgcagagtggcctgttaggaggtgaaggaaatgcctgtggtgtgggctgggagttgtctgtggaattgactggagtggaggtgtgagagatgggattggagtgctgtccaaagagtgatgtgcaggcaggaggagtgtgaatggagggcctcaggccctggccctggtagctcaagggaggaggatgagtctgagtttggttgtcttgggaggcaagatctgggtgactccatggcaactggctggcaggagaggatggatccccccacgggaggcccacattccttttctaccttatcttccatctgtttcctctgtgtgctggacacggtggccaatgtcaatatggagagaaaagtcactcatgccacctggatgtggtttctcttccacattgggagggtgtggaagagattgagcaaggaatggaggcgtaggggacagcgatgagatcctggagagagaaatgtagcagtcattttacctattgggttttaatttatggatgtgagtgattgatgctggggacaggccaatgactgaaagaagatatttattccttgcatttccccaaggggggtacataccacataacacagggccacatggtgaggcaccagatttggtcaggaggaaaattggagtgaggggaaagtttagtttagtccacggacgctattggggtttccaagggaaagcaatgcagggctgggcgtcaggatagtttggctagtttaaataattccaggacacctgggctattgggactgtccctagttttgcagtacctggccctgggttgatttagagtacgggaaatattggcttggtttgagaatatgggcccagggtggtaggggagatggaaacacatttggctgttagtttggccctgtgtttaatgggtggtaaatataagtagaaaatagagaacttaagtaaatacagcttgaaaagaagctgcttatgtattcatctttcccaatttggcagggccgtgtggtctttgaggacgtggccatatatttctcccaggaggagtgggggcaccttgatgaggctcagagattgctgtaccgtgatgtgatgctggagaatttggcccttttgtcctcactaggtaaggccctcacacttgcccagtgtcctgggttaggctgtgttacccctttttacccaaaggcagctctgcgtttcccacagtgagaccgtgggtgctgcttcttttccctgtttcttggcatatatgctgtgggaggcagggctgggccgtgtgttttataccccctttttcctagcatccccatccctgctgctctgaggcttacaagaaagggctcaagagccagaaatgttgaatttggcatagagaccccaccagccttgtctgtccctggtcaggttactctgtccaaacacatgagacctgtgttctgttgtcccctttctctcactgatatttcttggtgccttcctgtgcttggaatttcaggcactgccctggtcactgattttggggactgctgagttgactatgcaggacgcaggactcttctgtgaagttcttacgattatagaatgtgggatgccatgggcttgatctctctgggcatgtgctctttactctttttctctttctttcccctagagagggccccaggcacctgagagggtggatattacttcaacaatggcattagaggctcagggacatggccctggtgcctgggaattgggaaaagggttgatgtcacagctggggtcaaatcaccctgggaacctgtcctgtgttcaccattgtttgttgccagggccactggccacagatttctaccttttcttccccattatcatttctagtatgactcctggcccctgcacctccaatgccccacagtctgtacttctggggccaccacccttcaaccattcttttccactgctccctttgaatgcctgccaacacgtggcctgtatttaacatggtgtgaggtctgcatgtatccctgaacacaagctcctctgtcacagtctgatctctctgggtttggagagaaccttctacacactgcttgccagtctccagcaaccatggcctgttgatggctgttttcagaggagtgagttggagaccctgccttctctctctgtaccatacccctcccttgtatgcttaccatcatcagggctctcccattatggggccttgccaggcccagccctgcatagtggaccctcctctcactggccttaatgtccatgatgtccccaatcccatggccttatttgtgtgtgtgcctgacacacatttgtgatggagctgcttcctcccaccagagtcaacatgcacttctccagcatttctgttctgacaggttcttggcatggagctgaggatgaggaggcaccttcacagcaaggtttttctgtaggagtgtcagaggttacagcttcaaagccctgtctgtccagccagaaggtccaccctagtgagacatgtggcccacccttgaaagacattctgtgcctggttgagcacaatggaattcatcctgagcaacacatatatatttgtgaggcagagctttttcagcacccaaagcagcaaattggagaaaatctttccagaggggatgattggataccttcatttgggaagaaccacagagttcacatggcagaggagatcttcacatgcatggagggctggaaggacttaccagccacctcatgccttctccagcaccagggccctcaaagcgagtggaagccatacagggacacagaggacagagaagcctttcagactggacaaaatgattacaaatgtagtgaatgtgggaaaaccttcacctgcagctattcatttgttgagcaccagaaaatccacacaggagaaaggtcttatgaatgtaacaaatgtgggaaattctttaagtacagtgccaatttcatgaaacatcagacagttcacactagtgaaaggacttatgagtgcagagaatgtggaaaatcctttatgtacaactaccgactcatgagacataagcgagttcacactggagaaaggccttatgagtgcaacacatgtgggaaattctttcggtacagctccacatttgttagacatcagagagttcacaccggagaaaggccgtatgagtgcagggaatgtgggaaattctttatggacagctccacactcattaaacatcagagagttcacaccggagaaagaccttataagtgcaatgattgtgggaaattttttaggtatatctccacactcattagacatcagagaattcacactggagaaaggccttatgagtgcagtgtatgtggggaattgtttaggtacaactccagccttgttaaacattggagaaatcacactggagaaaggccttataaatgcagtgaatgtgggaaatcatttaggtaccactgcaggctcattagacaccagagagtccacacgggagaaaggccttatgagtgcagcgaatgcgggaaattctttcgttacaactccaacctcattaaacattggagaaatcacactggagaaaggccttacgagtgcagagagtgtgggaaagcctttagccacaagcatatacttgttgagcaccagaaaatccacagtggagaaagaccttatgagtgcagcgaatgccagaaggcctttattagaaagtctcacctggttcatcaccagaaaatccacagtgaagagaggcttgtgtgctccatgaatgtggggaattctttagctaaaactccaacctcattaaacatcagagatttcacaatggagaaagtttaccattgactattgtaattgggtagtaatgttatataaattccacatttttatgcaactaatctccagaacatttttcctcttaccaagaagtaaaatgctgtacccattaacaacaactcattccccttccctacttccccagaaatgtctcaactatatttctatactctatggtacttatatgaggtaccaatagatatctatgaatttgatatatatttgtacctcatataagtggattctacagtatttatcttttgagactggcttatttcacttaggataaggtcttcacggttcacccatgttgtataatgtgtcagaatatccttcctttttaggtgaaataatattctatggtatttatataccacatttatttatccattcatctgttagtggatacttgggctacttccaccttttgcctattgaaataatgctgctatgaagatgagtgtacaagtgtctattcaagattctactttcaattcttatagggtatatactcagaaatggtggtgctggatcatataggatttctattttttttttttgtttgtttttgagacagagtcttgctctgtcacccaggctggagtgcagtgctgtgatcttggctcactgcaagctccgcctcccaggttcatgccattctcctgcctcaccctcccgagtagctgggactacaggtgcctgccaccacgcctggctaatttttttgtatttttagtagagacggggtttcaccgtgttagccaggatggtcctgatctcctgaccttgtgatctgcctgccttggcctctcaaagtgctgggattacgggcgtgagccaccgcgcctggccaggatttctatttttaatatttttgggaaaatttttccatagtacctgtgccattttacattcccaccagcagtgcacaaggattgcaatctatatacatcctcaccaacattgttcattttctatttctgtttttggggttttttgtagtgccttttgttttggatagcagctatcttgttggatgtgaggtggaatctatagtgtctttcatttttattttgtgaatgattgatgatgttgaggatcttttcatgtgcttgttaggcatttgtgtatctggaaaaatattcaagtcttttttttccatttttaatgggactatttgctttttgttgttgagttgtagttctttatacattctggatattaactccttaccaaatatatgctttttacatattacctcccagtccataggttgctttttcgctctgttgattgtgtcctttgatgaaattttaagttttgatgtactgttgactctttctgtctgtgggttctgtattcatggatcgaagcaaccatggatcaaaagtatttggagcatccatggattgcagtgatcattaatcaaaaatatttggaaaacaaaaagggtagttgcatctgtactaaacatgaacagacattttttcttgtcattattccctaaactatatagtataataaatatttacatagcatttacattgtattagaagttataaataacctaatgataatctatataggaagatgtgtgtaggttatattcaaacactatgcctttttatgtgagggacctcttgagcatcagatgattttggtatccacaaggggtcctggaatcagtcccccacagacaccaagggatgactgtagtgcattttatctatttttacttctgttacctgggcttttgatgttatatattaaaaaaaattagtatcaaatccaatgccaagcattttccctatgctttattctaagaattttatatttgaaggtcttacatttaggtcttttttttttttttcttttggaggcagagtcttgctctgtcacccagcctggagtgcagtagtggaatctcagctcactacaacctccgcctcctgggttcgagccatcaccccacctcagcctcccaagtagcttggattacaagtgtacaccaccacacctggctaatttttgtatttttagtagagatggggttttgccatgttggccaggctggtcttaaacttctggccttaagtgatccccctgcctcggcctcccaaattgctgagattacaggcaggagttgtaatgcactgtgcctggctacatttagatctttaatctacttggggttcatttttgcatatggtttaaggcaaaagtccactttatgtggctatccagttttccaagcaccattttttgaaaagagcatctttcctctgttgagtagtcttggcacacttgtcaaaatcatttgtccatatatgccatggtttatatgtggattctctattttattggtcatatgtctgtctttatgtcagtaccacacattttaggtgtgtgtgtgtgagactcagtgttgaggacaaggctagtgggctttcacactccagactgctgtattccagcccaaattactcaaattagccaatccatggggaacatggaaaacgtagctaatgcaatccgcttgccttacctaagttgtcccctgcagcctcaggttgctgttactgtgtttcagatgcaaccctctgtgggaccctacccaagttctctcattcttagctataggtaataaattgttctgattttgtgtatccaagtgacattgggttgtttcttgctatcagaagaacccagaaaagtattatgaatctagtgaatgttggaaaatctttagccattagcataacctcatttcgtgccagcatgttcaccctagagaaaagtagaagtgaaggcaatgtcatctttccttgttaacatgataactcagtagagcaatgctttggagattagctttttagggagagagccagcagttgagcctcctgcatctgaacatccacactagggatattgtctgtactgccagatatatgggaagattttgtgaactgtgttgcagttttcaacttgactggggcctttcccagagttatgcccctgccagtgcctatttaaaaatgtcatctcttttctaccaactggcaaagagccatggtgtgtagcattttagtcacattaaaatgcagttatggcagcatgctgtgttctctatctgaagaattcactagtcacttgaacactttggagtcctcacccccctcctatgattgattagggcatagacatcagccttggacagaagacatggactggctttggcaggcagattgcagaaatttcctttctccaggggaaagtattggttatctcattgatagtggtaggaggcagatacattgctaggcagactaaggacgggtccctggtgaaacccaaacttcaagccaacgacagtttaaagcctgaaaattgagctgccagttccaagtagagtccatgactggagtgagaacttcctcaatgccttttagccaatcaaatggtgctttttccaggcccacccatggaccaatcagtatgcagtctccattctgagcccataaaaaccctgggcccagctacacattgggctacccactttcaggtcccctcttgttgagagcttttctgccactcaataaagttccctgccttgctca

SEQ ID NO: 16 - DNA, 129 bp, Homo sapiens
ctttttgacattcatactagtggcctattgggagaaatccacacgggccatcacagcaccatccagtactgtgacttctccccacaaaaccatttggcagtggttgctttgtcccagtactgtgtagag

SEQ ID NO: 17 - DNA, 29 bp, Artificial Sequence
  Synthetic - single-stranded 2'-O-methyl modified RNA bases linked by a phosphorothioate backbone
uuuguggggagaagucacaguacuggaug

SEQ ID NO: 18 - DNA, 113 bp, Homo sapiens
gtctctcttgatcttggatgatgtttgggactcttgggtgttgaaagcttttgacagtcagtgtcagattcttcttacaaccagagacaagagtgttacagattcagtaatgg

SEQ ID NO: 19 - DNA, 29 bp, Artificial Sequence
  Synthetic - single-stranded 2'-O-methyl modified RNA bases linked by a phosphorothioate backbone
ucaacacccaagagucccaaacaucaucc

SEQ ID NO: 20 - DNA, 108 bp, Homo sapiens
gagcagccaccatatcctagctacaattctaactattggaattctactgcgagatctagggctccttacccaagtacatatcctgtaagaccagaattgcaaggccag

SEQ ID NO: 21 - DNA, 30 bp, Artificial Sequence
  Synthetic - single-stranded 2'-O-methyl modified RNA bases linked by a phosphorothioate backbone
uaguuagaauuguagcuaggauaugguggc

SEQ ID NO: 22 - DNA, 255 bp, Homo sapiens
aaccctggaatgaccctgccccattatccttatggagatggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaaagtacttcaccatggcctagcagtggctctccccagtcacccccttcacccccagtccagcagcccaag

SEQ ID NO: 23 - DNA, 32 bp, Artificial Sequence
  Synthetic - single-stranded DNA bases each flanked by three 2'-O-methyl modified RNA bases linked by a phosphorothioate backbone
gcatcttcttgtggtcgtacagtcggtccuga

SEQ ID NO: 24 - DNA, 147 bp, Homo sapiens
tttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttg

SEQ ID NO: 25 - DNA, 29 bp, Artificial Sequence
  Synthetic - single-stranded 2'-O-methyl modified RNA bases linked by a phosphorothioate backbone
guauuugaguuguuuggaccaguauuugu

SEQ ID NO: 26 - DNA, 716 bp, Homo sapiens
tacagtgaatgcaatccagagttactatcctcttctttgcttattcgcaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacag

SEQ ID NO: 27 - DNA, 32 bp, Artificial Sequence
  Synthetic - single-stranded 2'-O-methyl modified RNA bases linked by a phosphorothioate backbone
ucuagacucuucaucugugaaccugcgaauaa

SEQ ID NO: 28 - DNA, 30 bp, Artificial Sequence
  Synthetic - single-stranded 2'-O-methyl modified RNA bases linked by a phosphorothioate backbone
uguagagggggacuguaaucaaagaggucu

SEQ ID NO: 29 - DNA, 104 bp, Homo sapiens
gaattcgaatttagagtttaatttctcagagcattctctccaggaagaatttttacagtatctcaaagacttcacttgacttcttgatcctgcataaaaccaag

SEQ ID NO: 30 - DNA, 34 bp, Artificial Sequence
  Synthetic - single-stranded 2'-O-methyl modified RNA bases linked by a phosphorothioate backbone
aaauucuuccuggagagaaugcucugagaaauua

SEQ ID NO: 31 - DNA, 69 bp, Homo sapiens
tgggccgggcacggtggcttacgcctgtaataccagcactttgggaggccgaggcgggcggatcacgag

SEQ ID NO: 32 - DNA, 27 bp, Artificial Sequence
  Synthetic - single-stranded 2'-O-methyl modified RNA bases linked by a phosphorothioate backbone
caaagugcugguauuacaggcguaagc

SEQ ID NO: 33 - DNA, 118 bp, Homo sapiens
agaggaacataaaaagcattcgtccggttgcgctttcctttctgtcaagaagcagtttgaagaattaacccttggtgaatttttgaaactggacagagaaagagccaagaacaaaatt

SEQ ID NO: 34 - DNA, 27 bp, Artificial Sequence
  Synthetic - single-stranded 2'-O-methyl modified RNA bases linked by a phosphorothioate backbone
agcgcaaccggacgaaugcuuuuuaug

SEQ ID NO: 35 - DNA, 110 bp, Homo sapiens
atggccgaggctggcttcatccactgccccactgagaacgagccagacttggcccagtgtttcttctgcttcaaggagctggaaggctgggagccagatgacgaccccat

SEQ ID NO: 36 - DNA, 23 bp, Artificial Sequence
  Synthetic - single-stranded 2'-O-methyl modified RNA bases linked by a phosphorothioate backbone
cguucucaguggggcaguggaug

SEQ ID NO: 37 - DNA, 128 bp, Homo sapiens
ctgggctttttccctccttcccaatcgagtctgggcgtccagcccccgagtgctcgtcacgctggaccctggcgcggagccctggcatcacgactcggaggccgagactctctcctggagtcacccag

SEQ ID NO: 38 - DNA, 18 bp, Artificial Sequence
  Synthetic - single-stranded 2'-O-methyl modified RNA bases linked by a phosphorothioate backbone
cgugacgagcacucgggg

SEQ ID NO: 39 - DNA, 81 bp, Homo sapiens
gtaccctgcatgcatatagctgctgattctactcctgctattgctcacaaccctcagagtcaaactttgtgaccggcctag

SEQ ID NO: 40 - RNA, 27 nt, Artificial Sequence
  Synthetic - single-stranded 2'-O-methyl modified RNA bases linked by a phosphorothioate backbone
auagcaggaguagaaucagcagcuaua

SEQ ID NO: 41 - DNA, 211 bp, Homo sapiens
gcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaagtaggcacgggggtttaggggaggagggttgagtctgctggggcttgggg

SEQ ID NO: 42 - RNA, 28 nt, Artificial Sequence
  Synthetic - single-stranded 2'-O-methyl modified RNA bases linked by a phosphorothioate backbone
uuucgggcaaucuguaccucugcuugau

SEQ ID NO: 43 - RNA, 31 nt, Artificial Sequence
  Synthetic - single-stranded 2'-O-methyl modified RNA bases linked by a phosphorothioate backbone
cuacuugcugcacaugaagccgguggaacug

SEQ ID NO: 44 - DNA, 297 bp, Homo sapiens
gagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatg

SEQ ID NO: 45 - RNA, 23 nt, Artificial Sequence
  Synthetic - single-stranded 2'-O-methyl modified RNA bases linked by a phosphorothioate backbone
uccucugguuggaacacaucauc

SEQ ID NO: 46 - DNA, 37 bp, Homo sapiens
caggagtcctggcaaaataagcatgcaggtagtaatg

SEQ ID NO: 47 - RNA, 29 nt, Artificial Sequence
  Synthetic - single-stranded 2'-O-methyl modified RNA bases linked by a phosphorothioate backbone
auuacuaccugcaugcuuauuuugccagg

SEQ ID NO: 48 - DNA, 92 bp, Homo sapiens
gtaacagagccacaaatggtgcaccaagcctggtctccagggggatgcaaggagcatctgctaacactctaaactctgaaaccagcacaaag

SEQ ID NO: 49 - RNA, 29 nt, Artificial Sequence
  Synthetic - single-stranded 2'-O-methyl modified RNA bases linked by a phosphorothioate backbone
agaguuuagaguguuagcagaugcuccuu

SEQ ID NO: 50 - DNA, 4173 bp, Homo sapiens
gacagagtgagactccgtaaaaaaaaattttgttttcttctttgttgcagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcacacaaagcctgtttggttgtctcttcacaaggacgcgagtgaaacctcctt

SEQ ID NO: 51 - RNA, 32 nt, Artificial Sequence
  Synthetic - single-stranded 2'-O-methyl modified RNA bases linked by a phosphorothioate backbone
uggauaagaugucuucaugucugcaacaaaga

SEQ ID NO: 52 - DNA, 524 bp, Homo sapiens
aaaaaccactcagtcaaagttccccttttatttctctttgtgctcagtaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcctgagattgacaacgccctacagcaagacggaaacctccctttacagcaccaccttgcgattctgcagccacaaagttgagacttctgaacgtggcactcttctgttcccttactgtttcacgtgtacctgtgtcatctttcttgtttcatcgtaaacatacttctaaaattcccattttctttatttagaaatagaactacaagcggatggttaaacaatttaaacaaatggtccatggggaaaagtgaatttcacactgtcccccaaactttcagtg

SEQ ID NO: 53 - RNA, 32 nt, Artificial Sequence
  Synthetic - single-stranded 2'-O-methyl modified RNA bases linked by a phosphorothioate backbone
uccagaaauuucagcauccuacugagcacaaa

SEQ ID NO: 54 - DNA, 94 bp, Homo sapiens
aaacctgctctacgaactgtcagaaggcattgactcagagaacttaaaggacatgatcttccttctgaaagactcgcttcccaaaactgaaatg

SEQ ID NO: 55 - RNA, 26 nt, Artificial Sequence
  Synthetic - single-stranded 2'-O-methyl modified RNA bases linked by a phosphorothioate backbone
ucucugagucaaugccuucugacagu

SEQ ID NO: 56 - DNA, 129 bp, Homo sapiens
ctccggaaaggcccaccagtccctccgcctcccaaacacaccccgtccaaggaagtcaagcaggagcagatcctcagcctgtttgaggacacgtttgtccctgagatcagcgtgaccaccccctcccag

SEQ ID NO: 57 - RNA, 23 nt, Artificial Sequence
  Synthetic - single-stranded 2'-O-methyl modified RNA bases linked by a phosphorothioate backbone
uugacuuccuuggacggggugug

SEQ ID NO: 58 - DNA, 90 bp, Homo sapiens
ccagcagaggcctcggaggtggcgggtgggacccaacctgcggctggagcccaggagccaggggagacggcggcaagtgaagcagcctcc

SEQ ID NO: 59 - RNA, 19 nt, Artificial Sequence
  Synthetic - single-stranded 2'-O-methyl modified RNA bases linked by a phosphorothioate backbone
uccagccgcagguuggguc

SEQ ID NO: 60 - DNA, 86 bp, Homo sapiens
gccgaggaggagctcatcaaagcccagaaggtgtttgaggagatgaatgtggatctgcaggaggagctgccgtccctgtggaacag

SEQ ID NO: 61 - RNA, 29 nt, Artificial Sequence
  Synthetic - single-stranded 2'-O-methyl modified RNA bases linked by a phosphorothioate backbone
auccacauucaucuccucaaacaccuucu

SEQ ID NO: 62 - DNA, 559 bp, Homo sapiens
gcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccag

SEQ ID NO: 63 - RNA, 17 nt, Artificial Sequence
  Synthetic - single-stranded 2'-O-methyl modified RNA bases linked by a phosphorothioate backbone
uaucucucgccgggccg

SEQ ID NO: 64 - DNA, 896 bp, Homo sapiens
gcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaag

SEQ ID NO: 65 - RNA, 23 nt, Artificial Sequence
  Synthetic - single-stranded 2'-O-methyl modified RNA bases linked by a phosphorothioate backbone
ccuccuucuccguagccaaaagu

SEQ ID NO: 66 - DNA, 171 bp, Homo sapiens
agttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaag

SEQ ID NO: 67 - DNA, 30 bp, Artificial Sequence
  Synthetic - single-stranded DNA bases each flanked by three 2'-O-methyl modified RNA bases linked by a phosphorothioate backbone
cuuggaaggccgtctcgtggttgcgctgca

SEQ ID NO: 68 - DNA, 291 bp, Homo sapiens
tcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagt

SEQ ID NO: 69 - DNA, 24 bp, Artificial Sequence
  Synthetic - single-stranded 2'-O-methyl modified RNA bases linked by a phosphorothioate backbone
ucugguuccucuucgggaucuggg

SEQ ID NO: 70 - DNA, 275 bp, Homo sapiens
gcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacg

SEQ ID NO: 71 - DNA, 31 bp, Artificial Sequence
  Synthetic - single-stranded 2'-O-methyl modified RNA bases linked by a phosphorothioate backbone
guuuccgaaucuucuucuuccggaucuguuc

SEQ ID NO: 72 - DNA, 148 bp, Homo sapiens
gtgggctctgtgttgagagaacagggggctgagacttgggggccagaccattggtggctccacagacatcatactctgtccagaacggtgcagacctggcataacagggattctggattgcatctgtaaaaagggaggcctggactgg

SEQ ID NO: 73 - DNA, 25 bp, Artificial Sequence
  Synthetic - single-stranded 2'-O-methyl modified RNA bases linked by a phosphorothioate backbone
aagucucagcccccuguucucucaa

SEQ ID NO: 74 - DNA, 24 bp, Artificial Sequence
  Synthetic - single-stranded 2'-O-methyl modified RNA bases linked by a phosphorothioate backbone
ccuguucucucaacacagagccca

SEQ ID NO: 75 - DNA, 35 bp, Artificial Sequence
  Synthetic - single-stranded 2'-O-methyl modified RNA bases linked by a phosphorothioate backbone
guuaguaaccaaaacagcaugguaauggauagaaa

SEQ ID NO: 76 - DNA, 32 bp, Artificial Sequence
  Synthetic - single-stranded 2'-O-methyl modified RNA bases linked by a phosphorothioate backbone
uaagguguacagcucagugguaaagcauuuga

SEQ ID NO: 77 - DNA, 25 bp, Artificial Sequence
  Synthetic - single-stranded 2'-O-methyl modified RNA bases linked by a phosphorothioate backbone
aacagagaguggcccugagggucaa

SEQ ID NO: 78 - DNA, 124 bp, Homo sapiens
aatggagttggggaagtcagcataaagagcagatttccgggagaagatcacaggttggattttggacatggtgattctcaaatgtctcaagatggatatgtcacacagacaggtggacataaag

SEQ ID NO: 79 - DNA, 32 bp, Artificial Sequence
  Synthetic - single-stranded 2'-O-methyl modified RNA bases linked by a phosphorothioate backbone
cauguccaaaauccaaccugugaucuucuccc

SEQ ID NO: 80 - DNA, 127 bp, Homo sapiens
ggccgtgtggtctttgaggacgtggccatatatttctcccaggaggagtgggggcaccttgatgaggctcagagattgctgtaccgtgatgtgatgctggagaatttggcccttttgtcctcactag

SEQ ID NO: 81 - DNA, 29 bp, Artificial Sequence
  Synthetic - single-stranded 2'-O-methyl modified RNA bases linked by a phosphorothioate backbone
cugggagaaauauauggccacguccucaa

SEQ ID NO: 82 - DNA, 37 bp, Homo sapiens
ataaagaaactaaggctcagagaaggtcaaattgcca

SEQ ID NO: 83 - DNA, 30 bp, Artificial Sequence
  Synthetic - single-stranded 2'-O-methyl modified RNA bases linked by a phosphorothioate backbone
auuugaccuucucugagccuuaguuucuuu

SEQ ID NO: 84 - DNA, 35 bp, Artificial Sequence
  Synthetic - single-stranded 2'-O-methyl modified RNA bases linked by a phosphorothioate backbone
uuuuuaaguguuauauuguaccacauaguuuguua

SEQ ID NO: 85 - DNA, 35 bp, Artificial Sequence
  Synthetic - single-stranded 2'-O-methyl modified RNA bases linked by a phosphorothioate backbone
aaaccuacuuggaaagaccuggcauaaugauaaua

SEQ ID NO: 86 - DNA, 35 bp, Artificial Sequence
  Synthetic - single-stranded 2'-O-methyl modified RNA bases linked by a phosphorothioate backbone
aaagccuaaauacgacagaagcaaggcagguaaac

SEQ ID NO: 87 - DNA, 35 bp, Artificial Sequence
  Synthetic - single-stranded 2'-O-methyl modified RNA bases linked by a phosphorothioate backbone
aaaaaaauuauagggcccauccuagaugcacuuau

SEQ ID NO: 88 - DNA, 33 bp, Artificial Sequence
  Synthetic - single-stranded 2'-O-methyl modified RNA bases linked by a phosphorothioate backbone
auccagcuauauauccaaguaaaagcagcuuaa

SEQ ID NO: 89 - DNA, 179 bp, Homo sapiens
gtggtccccgacgagctgcagccatgggaaacaccaccagcgaccgggtgtccggggagcgccacggcgccaaggctgcacgctccgagggcgcaggcggccatgccccggggaaggagcacaagatcatggtggggagtacggacgaccccagcgtgttcagcctccctgactccaag

SEQ ID NO: 90 - DNA, 22 bp, Artificial Sequence
  Synthetic - single-stranded 2'-O-methyl modified RNA bases linked by a phosphorothioate backbone
uguuucccauggcugcagcucg

SEQ ID NO: 91 - DNA, 94 bp, Homo sapiens
ccataatgactttgttgccatcctggacctccctgagggagagcaccaatacaagttctttgtggatggacagtgggttcatgatccatcagag

SEQ ID NO: 92 - DNA, 27 bp, Artificial Sequence
  Synthetic - single-stranded 2'-O-methyl modified RNA bases linked by a phosphorothioate backbone
agguccaggauggcaacaaagucauua

SEQ ID NO: 93 - DNA, 132 bp, Homo sapiens
gattctttctactaatccagatacttgttgaagtgctgactagtttcttggggaaagatgtcaaggaagagttgaaattcctagactggtgagcagagattgcggagtacagaatagccatcacccactctg

SEQ ID NO: 94 - DNA, 33 bp, Artificial Sequence
  Synthetic - single-stranded 2'-O-methyl modified RNA bases linked by a phosphorothioate backbone
cuagucagcacuucaacaaguaucuggauuagu

SEQ ID NO: 95 - DNA, 37 bp, Artificial Sequence
  Synthetic - single-stranded 2'-O-methyl modified RNA bases linked by a phosphorothioate backbone
ugaaaagaaugaauacaauaugcacacccaguuuaua

SEQ ID NO: 96 - DNA, 35 bp, Artificial Sequence
  Synthetic - single-stranded 2'-O-methyl modified RNA bases linked by a phosphorothioate backbone
caauaugcacacccaguuuauaauuuaaguacagu

SEQ ID NO: 97 - DNA, 38 bp, Artificial Sequence
  Synthetic - single-stranded 2'-O-methyl modified RNA bases linked by a phosphorothioate backbone
uauuccaaaacaaucauguauguaaaccauugggauaa

SEQ ID NO: 98 - DNA, 75 bp, Homo sapiens
agtggccgtgccattttacattcccaccagcaatgtatgagagatccagtgtctccgaatcttcgccagcatttg

SEQ ID NO: 99 - DNA, 25 bp, Artificial Sequence
  Synthetic - single-stranded 2'-O-methyl modified RNA bases linked by a phosphorothioate backbone
ggaucucucauacauugcugguggg

SEQ ID NO: 100 - DNA, 40 bp, Artificial Sequence
  Synthetic - single-stranded 2'-O-methyl modified RNA bases linked by a phosphorothioate backbone
uuuacccagagaaaugaaaacuuaaguccacacaaaaacc

SEQ ID NO: 101 - DNA, 40 bp, Artificial Sequence
  Synthetic - single-stranded 2'-O-methyl modified RNA bases linked by a phosphorothioate backbone
uaauccauaccauggaauacuacucagcaauaaaaaagga

SEQ ID NO: 102 - DNA, 40 bp, Artificial Sequence
  Synthetic - single-stranded 2'-O-methyl modified RNA bases linked by a phosphorothioate backbone
ggauauacgaaugguaaauaagcacaugaaaaagauguuc

SEQ ID NO: 103 - DNA, 40 bp, Artificial Sequence
  Synthetic - single-stranded 2'-O-methyl modified RNA bases linked by a phosphorothioate backbone
agauaucacuacacaccuaucagaacagcuaaaauaaaaa

SEQ ID NO: 104 - DNA, 82 bp, Homo sapiens
cactatgttggccatggaaatgctatcaatgagctgaaattccatccaagagatccaaatcttctcctgtcagtaagtaaag

SEQ ID NO: 105 - DNA, 27 bp, Artificial Sequence
  Synthetic - single-stranded 2'-O-methyl modified RNA bases linked by a phosphorothioate backbone
ggagaagauuuggaucucuuggaugga

SEQ ID NO: 106 - DNA, 92 bp, Homo sapiens
atcatgctttacgattatggaatatccagacggacactctggtggcaatatttggaggcgtagaagggcacagagatgaagttctaagtgct

SEQ ID NO: 107 - DNA, 30 bp, Artificial Sequence
  Synthetic - single-stranded 2'-O-methyl modified RNA bases linked by a phosphorothioate backbone
agaguguccgucuggauauuccauaaucgu

SEQ ID NO: 108 - DNA, 81 bp, Homo sapiens
gttgagaacagactgtgagcatgagggagcagctactgcagtagtgttgatggtgtctggtctagaggtgtggctgtggag

SEQ ID NO: 109 - DNA, 22 bp, Artificial Sequence
  Synthetic - single-stranded 2'-O-methyl modified RNA bases linked by a phosphorothioate backbone
cacaccucuagaccagacacca

SEQ ID NO: 110 - DNA, 35 bp, Artificial Sequence
  Synthetic - single-stranded 2'-O-methyl modified RNA bases linked by a phosphorothioate backbone
aaacaugaccaaagccuaacuccugauauaaccac

SEQ ID NO: 111 - DNA, 35 bp, Artificial Sequence
  Synthetic - single-stranded 2'-O-methyl modified RNA bases linked by a phosphorothioate backbone
uucauaauuuuaccagcuacagcaaaaacaaacca

SEQ ID NO: 112 - DNA, 30 bp, Artificial Sequence
  Synthetic - single-stranded 2'-O-methyl modified RNA bases linked by a phosphorothioate backbone
aauccuacaagcauuugagcguaccuguuc

SEQ ID NO: 113 - DNA, 34 bp, Artificial Sequence
  Synthetic - single-stranded 2'-O-methyl modified RNA bases linked by a phosphorothioate backbone
accuuucgcaucaaaaaauccaaucacccuacuu

SEQ ID NO: 114 - DNA, 24 bp, Artificial Sequence
  Synthetic - single-stranded 2'-O-methyl modified RNA bases linked by a phosphorothioate backbone
uccaaaucucccacgacuuuuacc

SEQ ID NO: 115 - DNA, 148 bp, Homo sapiens; identical to SEQ ID NO: 72

SEQ ID NO: 116 - DNA, 22 bp, Artificial Sequence
  Synthetic - single-stranded 2'-O-methyl modified RNA bases linked by a phosphorothioate backbone
ccgagagaaguacacgaacaca

SEQ ID NO: 117 - DNA, 28 bp, Artificial Sequence
  Synthetic - single-stranded 2'-O-methyl modified RNA bases linked by a phosphorothioate backbone
agccacaagugcaaaguucuccagcauc

SEQ ID NO: 118 - DNA, 44 bp, Homo sapiens
atgtatccatttttgcctcatgtattttgaagtgctgttattag

SEQ ID NO: 119 - DNA, 30 bp, Artificial Sequence
  Synthetic - single-stranded 2'-O-methyl modified RNA bases linked by a phosphorothioate backbone
aaguguauguaccuaauaacagcacuucaa

SEQ ID NO: 120 - DNA, 34 bp, Artificial Sequence
  Synthetic - single-stranded 2'-O-methyl modified RNA bases linked by a phosphorothioate backbone
uacaugaggcaaaaauggauacaucugaaagaga

SEQ ID NO: 121 - DNA, 28 bp, Artificial Sequence
  Synthetic - single-stranded 2'-O-methyl modified RNA bases linked by a phosphorothioate backbone
gggguggguagagagagguauaaggaaa

SEQ ID NO: 122 - DNA, 35 bp, Artificial Sequence
  Synthetic - single-stranded 2'-O-methyl modified RNA bases linked by a phosphorothioate backbone
cagcagaauauacauucuuuucaagugcauaugaa

SEQ ID NO: 123 - DNA, 34 bp, Artificial Sequence
  Synthetic - single-stranded 2'-O-methyl modified RNA bases linked by a phosphorothioate backbone
acaaguagacagaaaaccagcaaggauauagaua

SEQ ID NO: 124 - DNA, 33 bp, Artificial Sequence
  Synthetic - single-stranded 2'-O-methyl modified RNA bases linked by a phosphorothioate backbone
gggauggagauauaccaugaaaaccuaaccaaa

SEQ ID NO: 125 - DNA, 127 bp, Homo sapiens
gaatcattgaccttcaaggacgtgtttgtggacttcaccctggaggagtggcagcaactggactctgcccagaagaacctctacagggatgtcatgcttgagaactacagccacctggtgtccgtgg

SEQ ID NO: 126 - DNA, 33 bp, Artificial Sequence
  Synthetic - single-stranded 2'-O-methyl modified RNA bases linked by a phosphorothioate backbone
aguccacaaacacguccuugaaggucaaugauu

SEQ ID NO: 127 - DNA, 25 bp, Artificial Sequence
  Synthetic - single-stranded 2'-O-methyl modified RNA bases linked by a phosphorothioate backbone
gguucuucugggcagaguccaguug

The invention claimed is:

1. A method for the screening of splicing variants or events of a target gene, the method comprising:
   (a) providing a first antisense oligonucleotide capable of inducing a first splice event on the target gene to express a first splicing variant, and a second antisense oligonucleotide capable of inducing a second splice event on the target gene to express a second splicing variant;
   (b) hybridising the first and second antisense oligonucleotides to a pre-mRNA of the target gene in separate wells in a plate template; and
   (c) characterising the effect of the splice event,
   wherein the first and second splice events are opposing events, the first antisense oligonucleotide induces the splice event and a second antisense oligonucleotide reverses the splice event.

2. The method according to claim 1, further comprising:
   (a) providing a group of cells having two or more splicing variants or events of the target gene; and
   (b) hybridising the first antisense oligonucleotide to a pre-mRNA of the target gene expressed and the hybridising the second antisense oligonucleotide to a pre-mRNA of the target gene expressed.

3. The method according to claim 2, wherein the first antisense oligonucleotide switches the splice event of the target gene that expresses the second splicing variant towards the splice event that expresses the first splicing variant, and the second antisense oligonucleotide switches the splice event of the target gene that expresses the first splicing variant towards the splice event that expresses the second splicing variant, the hybridisation of the first and second antisense oligonucleotides to the pre-mRNA of the target gene is carried out in separate wells in a plate template.

4. The method according to claim 1, wherein the method further comprising:
   (a) providing a first group of cells and a second group of cells, each group of cells has a different splicing variant or event of the target gene; and
   (b) hybridising the first antisense oligonucleotide to a pre-mRNA of the target gene expressed in the first group of cells, and the second antisense oligonucleotide to a pre-mRNA of the target gene expressed in the second group of cells.

5. The method according to claim 4, wherein the first antisense oligonucleotide switches the splice event of the target gene expressed in the first group of cells towards the splice event of the second group of cells, and the second antisense oligonucleotide switches the splice event of the target gene expressed in the second group of cells towards the splice event of the first group of cells.

6. The method according to claim 5, wherein the step of determining the effect of the splicing variants comprises identifying the splicing variant expressed by the target gene.

7. The method according to claim 6, wherein the splicing variant or event is identified by detecting a phenotype of the cells expressed by the splice variant, and correlating the splice event with their relative expression in the at least two groups of cells.

8. The method according to claim 7, wherein phenotype of the cells comprises detecting a characteristic of the cell selected from the group consisting of cell morphology, cell viability, cell proliferation, cell death, cell cycle, cell migration, invasiveness or senescence, sensitivity to pharmacological or biological agents, or cellular, molecular, biochemical, metabolic, epigenetics or bioenergetics markers.

9. The method according to claim 1, further comprising providing and contacting the target gene with a third antisense oligonucleotide or an inhibitory reagent to inhibit, suppress or knockout the target gene.

10. The method according to claim 1, wherein each antisense oligonucleotide induces one or more splice events, the one or more splice events is or are induced by steric hinderance exerted by the antisense oligonucleotide.

11. The method according to claim 10, wherein splice event is induced by steric hinderance exerted by the antisense oligonucleotide.

12. The method according to claim 10, wherein the splice event is any one consisting of:
   a) One or more (consecutive or non-consecutive) exon exclusions;
   b) One or more (consecutive or non-consecutive) exon inclusions;
   c) Selection of the proximal exon between a pair of mutually exclusive exons;
   d) Selection of the distal exon between a pair of mutually exclusive exons;
   e) Usage of the proximal alternate 5' splice site for one or more exons;
   f) Usage of the distal alternate 5' splice site for one or more exons;
   g) Usage of splice site between the proximal and distal alternate 5' splice sites for one or more exons;
   h) Usage of the proximal alternate 3' splice site for one or more exons;
   i) Usage of the distal alternate 3' splice site for one or more exons;
   j) Usage of splice site between the proximal and distal alternate 3' splice sites for one or more exons;

k) Retention of one or more introns;
l) Restoration of one or more introns;
m) Circular- or back-splicing of one or more consecutive exons; and
n) Linear-splicing of circular RNA encompassing one or more consecutive exons.

13. The method according to claim 1, further comprising providing a plurality of antisense oligonucleotides that are capable of inducing at least one splice event on one or more target genes.

14. The method according to claim 13, wherein the method is carried out in a 96-, 192- or 384-well format plate and is capable of a high-throughput screening of between 10 to 1,000,000,000,000,000 or more splicing variants and alternative splice events.

* * * * *